United States Patent 10,233,495 (METHODS AND COMPOSITIONS FOR SCREENING AND TREATING DEVELOPMENTAL DISORDERS) - sequence listing, part 34

SEQ ID NO: 312 - DNA, 541356 bp, Homo sapiens
  misc_feature (419967)..(469966): n is a, c, g, or t
atgggttttatagattccatccatcatttgagtcattctgctgtattgtcttctaaaccgtcatcaaccagtgcatctctgggggctaaggccaaatccagcagcaaccccatcagcttgccaactccccagaatccccccaaggaggccgaccaggcccattcaggtatgcaacagccaatggggcagaagcttcatctcctctttgatttttcttcaaggacagaggtttggactgttaggggcgtaaattcatcaaaacctagacagaatcaagaaaccaccctcattcaccaattgtgtctgatttaagaaaatattttagaaaataagtaatccacatcaggttttgatccgcacaccagctttgaccagtagttggctgaccatttaaaaagaaacatttttattggttttctctcattttatcctgggaggaaagaggaaaaatgtttctcccaggattacaacagccataggatgaaaagaaattcacatctactgatccactgtatgtgttacccattaaatctgcatggagatcctccccaagagacagtgctacttatttcatagccaaggacgctgagaacagcctcagacaaggttctgttcatagtacattaccattaatggatgtatgaatggattggcagtccttgatatgtacgtagtgcatatcttgggggcagttaaaagggtgcatttcatttacaagtccagcttagttgccagagggtacactgctcattcacagccctgtaccaggggtggcaaggaaaaggcaaaccttgtcttcacctcctacctcccaccatagctggctggctgccttcagtatggtttgttgtgaggtttgacttgagtagaggtgctcccagaaagcacagtgctttcttctgctgccctcatttccctgaaggcaattcaaccaaaatcttaaagaagaggaagtgttccaatgcttcctgagcctggtttcaaagtttctaggccagagtgggcagcagctggaccagaatcatgaagtaaagctttgcttccagaattgtagacatctgcttaaatgttttgggttcaaacagagcagaagatgaagaatggaggatttaaaaatcagaatgcctcctcaaagaatgtctgggctgtgttacctggcaatttgagtgtatttgcagttttgatctgaaatggtgtcagcactgttgggttgtgttttaggacgtaatcattgtcttctacattagacattctctatgggtcagccttggtttctgccccccaccattggctacctgccctttaattgcttttagggaagaggaaacaattttaaacattgaaacttgacagggcttctaaagatctatctgacagagtaaccaaggaagaagagtctgctgtgatcttctcactctccccacaatggctcaccttgtgccccacagcatgtacatgcccatggaggccagggtgacagaggtaacttgtagagtcaggagcagagcaaagatcctgatccactggtgcttgtgcatggcacttggacccacaaggtctctaaaaacttgtctgtaggtgggctgcctaaagatcaccagggaagactttttttaatacaaatttcctgttccaagaatttataattctgtaagtctacattaatgcctagacagaatcaagaaggcctaaagaatctacatatattaagagtttttgctatgtgatttaaatgcccagaagggtttgcaagccattttgtctaagccactctaccaaggcatctatttttaatttggtgattgaacacgttgatttggaattctgaagtttgtttccatcagagtcctcaactgcatgcactagtaatgaaaatttccccacagcctttgttcatctctctcctactcaggatgggacctgatgccatcagagaggagttctaggtggagaaagagtcttgtcccaaggccaaggactgatacatgctgggagcagagccccaggggcccttgagagcattcaggctctctgacttttccatgcccaggattgctggcgtggggctcaataatgccaccttaccttgtttagccaattgctttcaagatgaacacagaggttgtatgcaggatagccctggcaggggaaaagagggaaggtcagccaggccagattctctggtagcaatggtcactcttggctgtctcatcctgtaccacactaggtaatagccactctgcagggtgatgtctggttctcaatcttttgctcattcttttctctcattttgatgatgtgtctcttttctccctaactttctgtttctaggcattttcactccatacccaagctgactagacttcctcaggcaccattgccctcagctccatccagtttcctgcctttcaggcccactggccctcccctccttggctgctgtgagacaccggtggtctccttggctgaggctcagcaggagctgcagatgctgcagaagcagttgggagaaagtgagcacttctgcatttgtgtgcttgtgaatggcagccccacactgtgttgctctgcatggatcgggctggatggcagagttcaaagaaacaatatggggacatgttacaaatggaagactgagggaaagctctgcttgcttattttttggaaatgtatttcctgttatttctctgatgtgtgtctcatcagttaacaggtagatatgttcaagaggctctagacctggtgctttcacactgtagatagtgtaggataccaccaagtatgctgaatccctgacagactggtggactgctcattggtaggggatgggaggagatgttatgctttgcctatgcaggatgaagtggccaagaaaaagagggccacattcagtgggctcctttgtgtggctattacacttttctgctgtgaaatgctgttaatcaagttcagttcctgacatcattaggttggagcaaaaagggtaatggtaccaaagtgtcagctatggcatctgactgtgaatcctatcttctgactcccaaagataattgaccttatatagttatgtagactgtggacagtcaccttttagaaaatgctagatatatttgtaggctggatgctcatcataaatttagtatgctggtggtcattgatagcttaaaaaaaaagacaaaccttcacatgaatttgctctctcgtagcaccttaagcacaacagttagaaagcagtttgaatgaacttaaactcatttgtcaggcactttctgtgcctgcaaagaagcttaggtgagccagagactgatagggtcaccatgccagcagtttctagtgaagcaagacaacagccaagaatttgcatccccctccctgtagccctaaatgtcatgtggaccaacctatttctttccttcttcctttctttttttttttttttttttttttttttgagacagggtctcactttgtcacccagactgaagtgcagcggcatgatctcggctcattgcagccttgacctcctgggctcaagtgactctcccacttcagccccccaagtagctgggattacaggtgtgtgtcaccatgcctggctaatttttgtattttttgtagagatggggttttgccatgttgccaagactggtctagagctcctgagctcaagtgatcggcccacctcagtttccaaaagtgctgggattacagacatgagccactgcacccagcctagcctatttattttgtcaacccagcaaatggatactttgtctagtgcagggaactctaaagctcagggaagtgaagttacttgttcaaggtcactaggtgggagagatgggcttgaatctggtcttccgctccaggtttcacgtttctgttataccttttctgcttaggatggctttgtcaccatcctgcttagagtatggggctgagatcagctgatcaaactctggggaatccttgcaacaatttttttcctctctttagagaccagtaggaggtgctggtgtttctgacccaaaacttgttactttagcagttgtggcaccagcaatgggtgggcaaaaatgtcccccaagacaaatggcaagagtattttctagtttccatttcttcctcttgcctccttttcctttatctatccacatttgtccatttgtctttgcccaaagggaaggatggaaggagagcactgtccatgaaaaagggtctattgttttgggttaaattggaattacgtcaagtctgaggtcattgactggagatcaaatggtcccagcctagatgaggaagattgtagccctttctttctccacctgaagtcaaggtcctctccaagggccattgcttatccaagctcactgtttgcgttgagccaattttccgtgtggacagtggtgcatggcggcctctcaggtccctgggttaaaatcttgtgcaagagtctgtatggtatctttgcatggtttagagcatgtactgtgtattgtgtggccaatggactggaacatgagaatactgatcattgttactgatagacttaaaacctcacatggccttgattaaaaagtaagctgactatctacaaccactgatttctccctttgccttgtgtttggatggggttgaaggcagtttgaaagaggcaggaaatcacgtatttgttgcatcccttcaaaaatgtaggtgcttaaatttttaatcttcttccttaactaagtgatcctgatgaatatctagtattttgcaaattggaggagagactcatcacaagacttctcaaacttctgcctgttagaatcacctcagtatatgtttccatactttctcagatgattccaatatgtaccaacatttgagaaccagctacaaatggggctaaaagctggcaactggcaattacactaacccctccgaggagtttggcttggttggaagaaacaatgacctcactcctgttgcttaggaggagctacctgtctattctgctgcccatgttcataatccctgaaagaaagcaggcttctgaattttctcctaaattgcacttctgcccacctctttccctatctcctctatgctgggcttctttttacagagaagtggagatgaaggggctcaagggaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtaca

SEQ ID NO: 313 - DNA, 539103 bp, Homo sapiens
  misc_feature (417714)..(467713): n is a, c, g, or t
ctggttctcaatcttttgctcattcttttctctcattttgatgatgtgtctcttttctccctaactttctgtttctaggcattttcactccatacccaagctgactagacttcctcaggcaccattgccctcagctccatccagtttcctgcctttcaggcccactggccctcccctccttggctgctgtgagacaccggtggtctccttggctgaggctcagcaggagctgcagatgctgcagaagcagttgggagaaagtgagcacttctgcatttgtgtgcttgtgaatggcagccccacactgtgttgctctgcatggatcgggctggatggcagagttcaaagaaacaatatggggacatgttacaaatggaagactgagggaaagctctgcttgcttattttttggaaatgtatttcctgttatttctctgatgtgtgtctcatcagttaacaggtagatatgttcaagaggctctagacctggtgctttcacactgtagatagtgtaggataccaccaagtatgctgaatccctgacagactggtggactgctcattggtaggggatgggaggagatgttatgctttgcctatgcaggatgaagtggccaagaaaaagagggccacattcagtgggctcctttgtgtggctattacacttttctgctgtgaaatgctgttaatcaagttcagttcctgacatcattaggttggagcaaaaagggtaatggtaccaaagtgtcagctatggcatctgactgtgaatcctatcttctgactcccaaagataattgaccttatatagttatgtagactgtggacagtcaccttttagaaaatgctagatatatttgtaggctggatgctcatcataaatttagtatgctggtggtcattgatagcttaaaaaaaaagacaaaccttcacatgaatttgctctctcgtagcaccttaagcacaacagttagaaagcagtttgaatgaacttaaactcatttgtcaggcactttctgtgcctgcaaagaagcttaggtgagccagagactgatagggtcaccatgccagcagtttctagtgaagcaagacaacagccaagaatttgcatccccctccctgtagccctaaatgtcatgtggaccaacctatttctttccttcttcctttctttttttttttttttttttttttttttgagacagggtctcactttgtcacccagactgaagtgcagcggcatgatctcggctcattgcagccttgacctcctgggctcaagtgactctcccacttcagccccccaagtagctgggattacaggtgtgtgtcaccatgcctggctaatttttgtattttttgtagagatggggttttgccatgttgccaagactggtctagagctcctgagctcaagtgatcggcccacctcagtttccaaaagtgctgggattacagacatgagccactgcacccagcctagcctatttattttgtcaacccagcaaatggatactttgtctagtgcagggaactctaaagctcagggaagtgaagttacttgttcaaggtcactaggtgggagagatgggcttgaatctggtcttccgctccaggtttcacgtttctgttataccttttctgcttaggatggctttgtcaccatcctgcttagagtatggggctgagatcagctgatcaaactctggggaatccttgcaacaatttttttcctctctttagagaccagtaggaggtgctggtgtttctgacccaaaacttgttactttagcagttgtggcaccagcaatgggtgggcaaaaatgtcccccaagacaaatggcaagagtattttctagtttccatttcttcctcttgcctccttttcctttatctatccacatttgtccatttgtctttgcccaaagggaaggatggaaggagagcactgtccatgaaaaagggtctattgttttgggttaaattggaattacgtcaagtctgaggtcattgactggagatcaaatggtcccagcctagatgaggaagattgtagccctttctttctccacctgaagtcaaggtcctctccaagggccattgcttatccaagctcactgtttgcgttgagccaattttccgtgtggacagtggtgcatggcggcctctcaggtccctgggttaaaatcttgtgcaagagtctgtatggtatctttgcatggtttagagcatgtactgtgtattgtgtggccaatggactggaacatgagaatactgatcattgttactgatagacttaaaacctcacatggccttgattaaaaagtaagctgactatctacaaccactgatttctccctttgccttgtgtttggatggggttgaaggcagtttgaaagaggcaggaaatcacgtatttgttgcatcccttcaaaaatgtaggtgcttaaatttttaatcttcttccttaactaagtgatcctgatgaatatctagtattttgcaaattggaggagagactcatcacaagacttctcaaacttctgcctgttagaatcacctcagtatatgtttccatactttctcagatgattccaatatgtaccaacatttgagaaccagctacaaatggggctaaaagctggcaactggcaattacactaacccctccgaggagtttggcttggttggaagaaacaatgacctcactcctgttgcttaggaggagctacctgtctattctgctgcccatgttcataatccctgaaagaaagcaggcttctgaattttctcctaaattgcacttctgcccacctctttccctatctcctctatgctgggcttctttttacagagaagtggagatgaaggggctcaagggaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtaca

SEQ ID NO: 314 - DNA, 533669 bp, Homo sapiens
  misc_feature (412280)..(462279): n is a, c, g, or t
acttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtaca

SEQ ID NO: 315 - DNA, 375995 bp, Homo sapiens
  misc_feature (254606)..(304605): n is a, c, g, or t
atttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtaca

SEQ ID NO: 316 - DNA, 406251 bp, Homo sapiens
  misc_feature (284862)..(334861): n is a, c, g, or t
ctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtaca

SEQ ID NO: 317 - DNA, 39701 bp, Homo sapiens
agccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccattccctgtagtcatttccattaatataaatagttaacgtttgacgggtatgttcatgtcagtcattaaaggagatgctttatgtgtagctgtgcagctgtgggaagttgctgctgatctctgagcctccatttcatcatctgttaaatggggatgaggataaactacataggcatgttatgaagacaaaatgaggttatgtctaaaatacttagctgggcgcttgacccatagtaagtgctcagtcaggaatagggttgttttttgtttgtttgttttgagacagagtttcactcttgttgcccaggcgggagtgcaatggcactatctcggctcacctcaacctctgccttctgggttcaagcgattctcctgcctcagcctcccaagtagctgggattacaggcatgcatcaccatgcctggctaattttatatttttagtagagacggggtttcgccatgttggtcaagctggtctcgaactcttgacctcaggtgatccacccgctttggcctcccaaactgctgggattacaggcatgagccatcacgcccagcctgtttgttttttgagacagagtctcactcttgttgcccaggctggagtgcaatggtgcgatctcggctcactgcaacttctgcctcctgcattcaagcgattctcctgcctcagcctcccaagtagctgggactacatatgcccgccaccatgcctggctaatttttgtatttttggtatagacagggtttcgctgtgttggccaggctggtctcaaactcctgacctaaggtgacctacctgacccagcctcccagagtgctggattacaggcatgagccactgcgcccggcctatttgtttttttgaggcagagtctcactcttgttgcccaggctggagtgcagtggtgcaatctcagctcactgcaacttctgcctcttgggttcaagcgattctcctgcctcagcctccctgaggctgggactacatacgcctgccaccacgcctggctaattgttgtatttttagtagagacagggtttcaccatgttggccaggttggtcttgaactcctgacctaaggtgatccacctgccccagcttcccaaagtgctgggattacaggcgtgagccaaggcacctgacctagggttgttatatgtttgacatccgtcccatttgggaggccttctcatcagtcattttatgcctttaatgccattctaggtaggcaggaaaggggtcagggccagtgggcccatgtagcatatagggaaactgaggcccagagagggcaagccacttcaagaggacccaaactagatgccaggcaggccctctgcctctgggattttgcccatgtggctcacctggcctaagtctgctggcccaaggaaaagtttcaacccaaccctgccctttcccccattcctctcgtgcaggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctgatgcagagggtccacaaccacatttgggaaatactgacctaatgtacagcaggaaagcactttcatttgctaagaagtactgtttgcatatgaagagccactcagacctcagcatatagaaaggcaaggggccagggaagttactagaacactgactctgggtttgaattgcctgggtttgaatcgaatcttggtcgcttactggtgatgctacccaaggtgtccgtgccttcatttccccacctgtagaaatagggataggatagtgaaaggtattgaagatgagctgagaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttcttttttctttttttgagacggagtcttgctctgttgcttaggctggattgcagtggcgcaatctcggctcactgcaacctccactttctgggttcaagcgattctcctgcctctgcttcctgagtagctgggattataggcgcgccaccacgcctggctaatttttgcatttttagtagagacgggatttcaccatattggtcagggtgtctcgaacttttgacctcgtaatctgcccacctcggcctcccaaagtgctgggattacaggcatgagctacggtgaagatcttaaagaaggggcggtttggccggtcgtgctgactcatgcctgtaatccagcactttgggaggccgaggtgggcagatcaccaggtcggaagatcgagaccatcctggctaacacagtgaaaccccatctctactaaaaatcacaaaaaattagctgggcgtggtggcacgcgcctgtagtcccagatacttgggagggtaaggcagaagaatcgcttcaacctgggaggcagaggttgcagtgagccaaaatctcgccactgcactccagcctgggtgacagagcaagactccgtctaaaaaaaaaaaaaaagaagtggcagctctgtctgcttctcacagagttgctaggggcaagtgctgaggcaggcacctgccctcaggctccccaggtgggctgctatttgcctgtgggctctgcctgcccgcctgtccagtccccagggatctgaactcctgtgacctcccccttgctcttcttgccctttgcattgcctggcttggcctcattaatgtccccaaatctgtgttctctccagctcctctggcaacccctgacccccttcattcctcacagccagtcctaactcccctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggccccacccctgcctggggctctggccctgtgactcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggttcgtgagccctggcatggcctctgctgctctctgagctgctccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacggagacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgggtagggcaggctgggcagctgggcctctgtctcatagagaggcacatccctggctgaggagcccccaccacggggcggcatggccctgtcctggagaagcttccaggctgtgggaaaggaggtttagcccttcttttgggagcccccatctgagggaggtggctcagccctgccctgatgaatccttttggcgtgagggagaggctggctacacgggcagcactcactatgcatccaggggttggcagagggtccggcaggccagcgggaggggccgtgtttagagctaaaagtggacagtgcactgagcgggttgggagcagcccggggctgggggacacagcaggaccaagtctgaggagcccctctgtcccagagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggtgagcagccgcccccctcttccaagcagcataccctaaatggcactgtgtgcctgggggcctagttccccagggccc

SEQ ID NO: 318 - DNA, 442916 bp, Homo sapiens
  misc_feature (285173)..(335172): n is a, c, g, or t
acatgttacttcctattcccataaaccctccactgtaggattaacacctaagacaccaaccaagacacaaaccaatacaaaaaaagatatgacccttggcgtacagtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgaaacgttgtgcctctgccccgacacagcctcatacgcctcactctttacacacacggtcacttgccccgcgcactcccgagccctttccagccctgacacacagctgggattctcacttccgatcagcggtcctgaacccgctcccagggcacgggaactcccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagtcgccaagaggaagtgacgtctgcctctccctttttccctcccgcccctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcactatctgctgactcatctttgactttgttctcgcgatggtgtcaagagcctggacaccacggctggggtcgagatcccaccagtgtccagggacctcccccagcccaccagtatcagattctattccattgctcaaatcacaaaacatcgagtggagagttctctttggagaccgtaaagtaaagattctgtggcatggtggccagttaggccactggaagcatggcaaaatattgaaaatgagggattgggtgacagtgtagtaactgctgaatactaaatacttgatccaggccccattccctggagattgacagggagacacattgtccaggtagtagtggagaaatgctttctgggtatctgaccagcctttgtggaaagaactggcaccatcctgcagatgtaaccacctgatgggttcttcctgaccaatgtacacaaaaattcaattcatggagaccatggcactgcaggaaagagtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggtgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatggtttccagatgaaactgttccacctcaggtcatcaggcatcagttacagtctcataaggagtgcgcaatctggatcactcacatgagcagttcccaatagggtccgagctctgacgagcagctaatgctcatgctgatctgacaagaggcagagctcaggtggtaatgctcgaaagcctgcagctcacctcctgctgttcagctgggttcctaacaggccatggaccagtacctgtcttatggccctggggattggggagtcctgatttaaactataaactctatttttcccaaagatagcttgggagaaattgcacaggaatgagcaaagacagcaagcctgtgaggctagaaccaagatggagtcagccatgtcagctttctcttgttgtcataattttgcaaaggtagtttctgaggggctgcactggacacttcttaaaaacatgagacagatgttattgtatttactacagtaggcaagagagaccagcagagaactgggctcaacctcgaatacagcaggaggagttgaagattatagccaattggcaagataagaaagtcagtggatggaaaattactaagaggaacttgattagctatcaaaggtggttgcgaggactcttgctaaactagactcaacagtattctttcctaaaactggacttggcaggcaaagaaataacagagaaaagggctcagaggaaactactaaggtttggtcaaagactagagtccttgtcaactctacattgaagcttctgcaaataaacaaagaccaaccaaatgaaaaaaagcaaaagctatttattctgagcttgctatagcagggagtcagtcactgttatttgtgttttggcagagacttgaaggcagtcataaaggtgggaaagctttttaaaaagaaaggcttcaggggccgggcacggtggctcacacacataatctcagcacttcgggaggcccaggtgggtggtcacgaggtcaggagatcaaaccatcctgactaacatggtgaaaccccatctctactaaaaaatttacaaacaattagccaggtgtggtggcaggcaccagtagtcccagctactctggaggctgaggcaggagaatggcatgaacctgggaggcgaatcttgcagtgagccaagattacaccactgcactctagcctgggtgacagagcgagactgtgtctcaaacaaacacacaaacaaacaaacaaacaaaaaaacaaagaaaagcttcaggtatgcttggattggaggctgtcagcatggtgaagctgttgatagatgaagaaaatcaaagtattttaccccagaatatatttctttggcatattttaagatggctgtcagagagccagcaaacagaaggaactctgcaaaactgtcttttgtaggggaaatttacacctgcagagaatctgcattaatccagctttatcttgtcaggtttgagaaataaaaataagccctaggccctacaaccaactgaatggactccctcttggctgacaggaccacagagaaacttcgaaagcagtttctggatgtggcaggctaggaggttggacatgccacctcaaaaccctcccctcactaactgccattatgatgcaggagaacagcagagggaattggaagttggataaaaggcagagtgagtgaaagcagagaaagaagcaaggtgatggggtgggagagcaagaagcaagatataaggcagaagttgagcagccaaaacaaaaagtaagatttaaaaaagcaagcaaggctgggcacggtggctcatgcctgtaatcccagcactttgggaggccaaggcaggcagatcacctgaggtcaggagtttgagaccagcctggccaacatggcgaaaccccatctctactaaaaatacaaaaaattagctgggcgtggtggtgcactcctgtactcccagctacttgggaggctgagacaggagcatcgcttgaacccgggaggcagaggttgcagtgagccgagattgcaccactacactccagactgtgcaacagagcgagactctgtctcaaaaaaaaaaaaaaaaaagaaaagcaagccaggaccccatggccggtgagatccaaaccagtaaaggggcagctcctcagagataggcatgtgcattagagaaaaaaagtatccttaacatgactccatatgataatcagctcattaaaactcatgcatatggactgcacatcatgcatgtacttaaaattatgggatggaggcaatgtgcaagcacacaagggccaaagtaactaagcaacccacctatcaatcaaaaggcaaacactggctaacgattaggcatccttgggaagagaagagaaagaaacacacataaaaagacccaacgtacaccaaactaatactgatctcacatcccagagatcagcccactctccccactctgagactgttactgtgcttaataaattttgctttgctttgctgctttgtgtgtgtcatgtacagttctttgtttgggacaccaagagcctggaaatgcacggcaccatctggcaagaattaggattttttttcctaagggttaacaatccaagcctttggagagacttgcttcactgctgttatcaaccaacagcctgatgctttccctcccttttgtggttttgacaaaacaagcaagcagcattccctcctgataagagaccaccgacctaggaatcattctggccagactacagaggatgtacagtgagggttttcatgtccattgcctcagattttgacgtcagagggccacaaactccactctcagatgattgctaacgccaccattttatgaacatgagccccatggagaggcacgcagctcaactgcacatctgcacatttttcctcttataaacattcatattggaatattatttggtactgctcccgtgaaagatacatttgcagaatggactcagattagaagcattatacaagcactataatgtagcaatggcacatccagctctctacactatagaaatgtctgcagggtaaacatttccacaatgaccaaagatatctgtacaggactggtgactgcagcattctttgtaatcctaaaactatgaaactaaagtcatctcaaaaacattttgtttttttgagatggagtctcgctctgatacccaggcagtgcagcggtgtgatctcagctcactgcagcctccacctcccaagttcaaacgattttcctgcctcagcctcccgagtagctgggattacaggtgcatgccaccatacctggctaacaaaaacattttgaaaagggttaaataaatcatgcataaactgaggaaaaatactattttcaaaaatgatggagagaatcactttcatgatgaatgattccactggtcacattattgatagagcaatcaggaaacccaggcacatcctggaggtaatactggactcctattactaaaatatgaaaaaatggagacacgtaaatactcgtttaagcgtataacggactgaattagaattttatcacatcagaagtgggttcctaggtctctgtttcaggattccttagtgacacaggtgtaaacccggcatttcaggagatagccggctaagaatctggtcggggaggtgggcggcccttgacatggatctgtcataaattagtggcttgagactttgggaagataaaatcttccccatttatctagtgattgacattgcgtgaatgcttcaaaagttccaataagcgtccctgggtgggctcgaaccaccaacctttcagttaacagccgaacgcgctaaccgattgcgccacagagacaagcgcttccaactctactgggcatctaggaagggcgcactcactgaacttcctccgttccgtctattctcagggcccaccgggcaggaccactgagcaaggccttggaaaaccagagagattagagcggtgagtcgcgccggtcacgttggacgcctgcgtgttaggagattctggagccagaagaacagcagaattgccttcgcccgccctgcccctcgcctgctgcagaagcttccagaaactccctggtgggcgacccagcccgagctgcctggggccccaagggaagctgaacgccctgtgggctcctgggatggttcttcccgttctttgcgccgccttcacccattgaaggagcctgtgcccaccctgcccagtcgctttccgggccgctgaggagcttccgctgccatcttcggatcctgtgttccgcacgggggctccaccagggcagggatggtggtgagggtcgctcgtgggtcccctcgcggggagcagggtctggtactcaccagggcgcacgactaggacttgtggaatgaattcatcgtcgcctttagcttttagtcctttgaagagccctgagagtggaaatcaagagattttttccacggggaagttctttttacaaagcgttgatttctcggcacccggcagggagggcaactggcagggtctctggcgcaccttctgcgcggtggagccacgggggctcagctgggcggtggtgcggccgtggggtggtaggtcaagagctgggaaaggaaaaagcaaaagctgggaaagaagccggggagcggtggaccagacatccagacctcctgaaaggctcatgaaggggcacaggcaggatcttctggaagtgagaattgttttgtttgtttgtttgtttattgtagtagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttcaattgtctgtccgttaaataaataaaacccttttcctatatctttaaaattacgttggttttatcattttatgattacaagtaatgctgcagtcatcattcttgtacactctcattggccactggtgtatttctatagggtggaggcctggagagtagttgttccagcatagtgtttacatagcttttatttcattccgttttctttcctttgttgctttattagctataaccgttttcttatttcagaggctgctttagggtttccggaatacatctttaatttatcatagtctgctttctagtgtcattatgcctccctttctggcctttatcctagtgttatgtatctttactttatgcactataacctttgtgattcattattattacttttatttgttacgtcaaatattttttgaaagatttaaattataagaaaacgtgtagtacatgctttctaaatgccatttccaatattcgtttctttgtgtaggaccacatttttatctggtatccttttgcttctgcctggaggacgcaagatttcttgtagcgtgggttggtgaattcttttagcttccgtatgtttttcaatgttcttatttcactcacagttttgaaattttatttttgcatagaattctaggttaactttttttctctaggtactttaaaaatgttgccatttatgaagcattgtcatttaaaatatcatctttctttcctatgtttgtaaatatggcgtaaagccggtttcttgtgctggttatacaattttcagaatgtgtatttaaatttaaaatattaaattgtactaaaaaactaaaaatattaatcatgaatgtcctagattcatcttaagttccaacagtgcacttaaaatgtgcccaacctgagggtcaaacctacctgctgatgtggaatttgtgtttgtgagacattctcaacagcatttgctttccccagcctagtgattttcctcacatctgaatgtcttcattgcaaaaggaaacgtttttctttgcaaaaatactttaaaatattcttacttcaagtaggtgtactaaaaacaaatttctcagttgcatccctgaaatccatcgaaagcccgggagagacaatcaagtgcttcaggaccaagagtgaaacaggagaggacaaagcagggcttcttcactaggagtcaagccaaagtcaactgatttggtctccaatggagaacggaactcggttcaccagcaacgtgaggacgtggcccagaggagacggagtttcccttcatggtgccttcagataggaaatctaggattttctttctttccctttgatctacttccaactctccctttctgtttcttcaagatctttttcggatccctgggtgcgaaggacataaggggccagtggccttccctactggtccctccttgactgggtgtctttggagcccaagctcacccggaacattactgcccgctgcagacagtgagaggacaaaggagggcggtgggtgcagtgggaaccacagagtcaccgtgcacctgcgcccgtgggctcctagcaaattgaataaatgccccctgaagcttctctgcaggtcagagggaaggggagggtggctgccgacctggcgggagaagcttcaagaaacatcgggaggacttggccctgcccctgggccttgaagacaggcctggccaggctgattttgatgggtaggcccaaagaaaaggttcgagggcagcccaaaccccgaccctgagattaaggctcttaagtgtctgacagttttgagaatcgtcagtagaatcgatcctgcctgtatcaggagacttctttgccaaaattcagagaccaagaaagagaaagattgggcagatcaaaatctgtcattaaccaaacaggaaacataagttttctgacaaattgaatgtgtgctgtgagaaaaagactagcctcaaggagaacctggttttttggcttgagtgtagggaagaatggagttgccaccaacaatggtgcgttgaaacggcaggtgcatcaggctgtagatgtgaaggaattaaaaatattttaccccaaactacatttctttgacatattttgagatgtctgttcagaaagccagctgcagaagtagccctgcaaagttgtcttttgttggggagatttgcatctgtagggaatctgcattgatacagccaagtctttccttgtccagatctaggaaagatgaactgagagtctgacacctgtaaaggtctgaaagaaacttttagggtttattctctctgagagctgctacctgtaaggtttcatttacatattaagaccacctttgctagccgagcctcattttctctccctgccatcacttatcttgtccacaataaatggatatacctctgactctgattgcacctggttttggccatgctttgagccctcattcattctgttatctcgagatggtatataagcttctgcatcccattgtgggtaggggagggtaatcactctgtgactctccccatgcacatgttagtacattttatgccttttctccaattaatctgccttttgtgacttgatttttgagtgaaacttcagagagttaagagggagggtttccattggcccctacagttttggagctgtaaacaggataggaaagctctgctcttctggaagctgcagtgaagaacccaggatatgatcagctatcataagggtaagaatttttttaccagccaggctcctggcctccttctctgtgtggaatctcatcaagtggatggtaaaaatcactgtttctttcttttccctctccaaaatcttgattaattggagaaaaggatttgtgtgactagtcttgggtgtagtgactctggtgtgctttttggtactttgtggtaccaattcctattgtttaatccctttcttcccagaaattgtctgttcctttgtctttgtctctatgtgttattctgtcataaaagggggtactggttgaggttccttctcatcttattttatgtccttgagagcttgacttgtgaccaagtggaagcgctttctcttggtttccactatctggaaagaggcggtaactttcaggtcatactaggtggcctgtctgaaaatggctgggaaccccagcacactttttgttctgaccatgacaagctcttggggtttgtcttaagaagtcccatccctttgaggcttttgtcatctcaattcttgttgcctggttagttctaggaaagctcaatcccaagatggcctacctggtatcatggattcacaggtctgtgactggaagtccccataaatttgtgggttgctggaggcaaacatcatccttacccatctgtggtctactctactaaaaatacaaaaattagccaggtgtgatggcatgcgcctataggcccagctactcgggaggctgaggcaggagagtcatttgaacccaggaggcggaggttgcagtgagccaagattgtgccactgcacactagcctgggtgacagagcaagactctatctcaaaaaaaaaaaaaaaagaaagaaagaaaagatttaagagaacaattattttaattgaatacattttgtcaagattaactcaactttcccctagagtagtgaaagaataagcaatcgtaatttagattctaagttactggtctttgagaaagtgtgaaaaccaaaaaggtgccataagtcaaaaagagcaaaagtcctaattttcaaactgatgaaaataaagtactaaaaaattgaaatcatcatagttcatcttggtccttggcaaaatacaaatgtattgattcaaattataatatcttagctaccctattgtgcgtagctcttaccactgaggagaaaaaccaaacccaaacaaaagtgtgttcaagttggcaacaatgtttacaaacctgcaaaatctcttcagcctatcccttaaactccagacttggtatttactaagctctgtggtgtacaatacccaccttaatatccattcttgcacaagttctgttaggtataagccaagatgacatgagatttttttttttttttttttttttttaccctctcatgcctatgtttgcttttgcttccacagacccttctgagtaaggactatcctcagactactggaggcacttagtcacaagcttgcctgaggctcagagctggcaatacctgggagtttatgtcaatcccacagcacccagcaaccctgcctgcaaaatatttacccatgattgacaggtgcaggtgtatgaaagcccagctccttgacttgaggggcacctttgtggtgaattaggtttggcaaaagggaatccagaggccaactttgtaaaaatgcagatagataaatagaaagaaatctttgccttggaagtccagttgagaaagagagtgatttacttgagactctgaaaacagagactaaaatctgtactttttcatgggaaagaagcctatggtgaaagagaaacaaagagaaaggtaggaaatagggtgggtctactccgtagctttaaaccactctgtcatattataaagcccggtgaggttttaactaacacaagtgtctggactctacacatagagattctgatttaaacgcttccaggtgggtggaagccactagtagtcttaaaacactcccaagtaattttaccatgtggctagagatgaaaaggacaatctatctactagaatctcaagtaaccattattgaagtgccccaaatgtgcagctacctcatagaaaaggcttaacaccaccctttgatggaatttcccttcctctctccatggtcttgtctgcatagcatggaaaatagagaagagataaagaggtagatggagaggttgaacctgtaatttgcctatgtagagcagtttctcaaacttttctgaccacaagatgcagtgagaaatatacaattctttgtgatcagttttttttttttttttttttttttttgagatggagtcttgctccgttgcccaggctggagtgcattggaatgatctcggctcactacaagccccaccctcctgggttcacaccattctcctgccttagcgtcctgagtaggtgggactacaggcacccaccaccatgcccagctaatttttttttttttttgtatttttattagagacggggtttcaccgtgttagccaggatggtctcaatctcctgacctcgtgatccacccgcctcggcctcccaaagtgctgggattacaggcgtgagccactgcgcctggcctgtgatcagtttttaaaaaatcttttactatgtgtaatccaccctacctagaatttaaataaagcctgcagtagtaagcagtcgactatattgatttcacaacccctaagtggttcagaattgcaattagaaaatttttccttttggccaggtgtggtggctggagcctgtaatcccagcactttgggaggatcacttgaggtcgggagtttgagaccagcctgaccaagatggaggaaccccgtctctactaaaaaaaaaaaaaaaaaaaaattagctgggcgtggtggtgcatgcctgtaatcacacctacttgggaggctgaggcaggagaattgcttgaaccccaggggctggaggttgtggtgagctgagattgcaccattgcactccagcctgggaaacaagagtgaaactgtctaaaaaaaaaaaagaaaataaataaatttttacttttgctctgcctttttatcaagcaaaatcccaaaagaacatttactataaacatctttctgtgaatccttatttctgtcccagccaccatgacccaataatctctagagcctgttagtgttctccagattgaagccttccctctaactgctcctaaactctgtgatgtagtggaaaagttttgaggcctcgattctcatcccaggtttttcacctacagatcatacggccttagcctcttgacaccattgtctccttatggccaaagatggaactgtacttgggtggtatctgagcaccctgttggctttgacattctagggctcttcccttggcaccactctcttatttaaaaggaacaggatgtggacttaggagggttatttctctgcaaactatcctctctttcttatgacaagctatttctgaatgtgcacatttgaggctaagcaaattccttcctgggaggttgaaagacccttatttctctccagaggagtattatggagagtcaattgatgctgaggaggtggtagagacctagtgaactcatctgcagtggctttgagcaaggcttttagaatcataaggtgggtggggtcctgtgtcctacaccacaggccagctagttcatttcaggagacttttttttcaatctattattactatcttcttctagactgtagttcactactggagattatccacttagttacactcagtttgcacctggcctgtatcaccagtcagctctcactccagcctcaggtatcagcaagacctcaccaaagattattgtttaattttgtgtgtgtgtgtttttgtttgtttcgggtaacaactaatgttggaactatgaaaagctcttctctacttttaacaaagcttagtcacaaacagttccccagttgatgagaaaaactaaaacaacagaacaattgaaagtccaaatctgcaagctcatctctgagaaccgaattctacagccactccagatttgtactccaaatggatagtttgattgtagaaatcacatcccttcagtctgccaatgtgataagggcccaagagacagtgatgcctagattcatagataatcccctttcccccatcctatatataactggagtcaacagcagctggaggaaaatggcaagaacttggaatcaagattaggttagaataacactgctgtagacagtttatcagctcttcagcatacgtccgttttccttgaaggatgagcctgtagaaacctctgacaataaagtttattttacacccattcccttgcctatgattttttcatacaaatcacaattataaaactttcttgctccagctaaaagcaggaaactcaatcatgaatgtgttcactaaatatataccacagaatgataacaaccagtctgattgcatcacttgattccaaaattaaatgttagccctcaggggtgcaactacatgtatctccaactctggaagccacaggcaacatattcctgtttccttgcagggaaacagatctataagcagggcggcagtctgacacatgtacattcctgggaaacccaaggaaacaatgatagtgacgcagggcaggcaagcccccaaactgaaagagttttgctaatgtcgcgattggctttctatgttatttgaagactgagatctccatgaggagtgaagataggtaatgcctaaggctgaggcatgacctcactgggtcaccttagctgtaaagtgaggtcagttgtcaccttgcaaaccttttggtaatccaaatcttggaatgatttctttaagaatttagacacttccaatacttttcctgtccttgtggggaaagcttctatccacctggtgaaagtgtctataaatactagcaaatcttgtagtcccctgtaaggtggcatctggtttaagtctgtctgccagtcttcaccatggtatgttccttggtgttgtacaggtttaagcagggatcggggtatggggtggcttcctgagtggtaaccctttttatagtttggaacagtcccttccgcaagaatatttaggaaactaatttaaatggaaaatcctgtcccaaatgtgaggaatcatgaaaatgtttaattatttcccatctgtcagcctcaggaatagagtttgttcttttctagcaaccatccagatgggtctccctggaagccttttactcagtccctttaatttccttaggggtatattatggtgtcactgacacggatggagtacctggtagtagcgcagcagcctgaaataccagggtttccttagctgtggccttagctgctctttccaccagggaatttcctctaataataaaagtgtctcccttctggtgtcccctgcggtgagtaattgttatttctttgggagttggacagcatctaaaagttccaagatctgagtaaagttgtgtgggggatcccttggctcttgatagtcccctttccttccctatggctgcatgagcatggagcaccaggaacccatatttagagtcagtcaacacattgactcttgaggttttgttctttttttttctttttttgaaacggagtcttgctgtgtcgcccaggctggagtgcagtggcatgatctcagctcactgcaatctcagctcactgcaaactcagggattctcatgccccagcctcccaagtagctgggattacaggcgacccccaccacacccagctaatttttgtatttttagtagagacggggtttcgccatgttggctaggccggtatagaactcccaacctcaggtgatccacccaccttggcctcccaaagtgctgggattacaggcgtgagccaccgtgtccagcttaagtcttttcatggttggaaggccctaattagagcagctaattctgctttttgaacagaagtctgagaaggtaaacccttggcctcaaaaacttcttgttggctaagcttcctttcttactccctcatgaatatagctatttccatctctaaaccactcaacatttgggttagacaagagcttgtcttcaaggttgggccttctagagtagagctcttccgtggtttccacacaggagtcaatgagtttgggatctgtttcttgagacgtgaggtgcagcaacagagtagcagggtttaaaaatcaggacactttcagggtaacatctggggtgtcaagcagaagggtctgatatttaagtaactggccccctgttagccattggtgtacttttgcctctaggaccctctgtactgtacttcatggggtggcagggggtgggggtgggggtggggtggtatggcatgtaattgttgtcccaaggtaaacttactggtttcgtctaacgatagagtgatggtagtcacagatctcaagcttcttggtcacctagctgccacctggtctagctgtttagagaaataagccactggtccaaagcaattcctcagcctttgagttagaacattcgaagctgtcccttgttattcatccacatagagggtgaaaggtttttctaagttcgagagtcctgaggcaagggatgtccctggcttttcttttaaggctaagaatgccttttgacaggttccaagctccgcctcctgggttcacaccattcttccgcctcagcctcctgagtagctgggactacaggcgcccgccaccacagccagctaatttttttgtatttttagtagagacggggtttcaccgtgttagccaggatggtctctatctcctgacctcctgatctacccacctcggcctcccaaagtgctgggattacaggcgtgagccaccgcacccggccaacaagtttttttttttaaatgaacagagcatcagtgaatgatagtgcaagtttaagacacctaatagacaagttaaaggagtcctccaggcagaaggaaactgacaccagatgaaaatgtggatgaaaaaaaaaaagacactagaaatgacatctacataggcaaatatataattttaacatctgactgtttagctgggcacgatggctcacgcctggaatcccggcactttgggaggccaaggaaggcggatcacttgaggtcaggagttcgagaccagcctggccaatatggtgaaccttcctctctacgaaaaattcaaaaattagtcatatatggtggcgcaagcctgtaatctctgctactcaggagtctgagtcaggagaatcgctcgaacccggaaagcagaggttgcagtgagccaagactgtgccactgcactccagcctgtccgatagagtaagactcgtcttaaaaacaccaccaccagcaacaaaaaagcaaaaacaaacaaacaaacaaacaaacaaacaaacaaaaacacatctgactcttgaaacaaaagtaatagagatggattgtaaggtttataacaggtgtaaagtaaaatgcatgacaatagcataaaggcagggggaggagtcatgtgaagaggtatgatgccacttgaaggcagactgtgatgggttaatttttgtggaaagcaaggcagaatttttgaagtttgtttcttcaaatactttctgtttcccgtacatacaagctagtttgttctgcagagatctcattttctaggaggctcggagggggaccttctgctgtctgtcctcatgggatgcacaagacacaagggaacagtctttcacttttaaatacattgatgggtctgaggagatagatacaactgcattttttttttaaatgaggtgggattctcattggtcttgaacttctgagctcagtggaggcttcccctacttcagcctttcaaagcgttgggattaataggcatgaggcactgcgcctggtcacaaccaacgtttaaaatcacgtccctgggtggtctgtaaccaccaaccttatggttaacagccgaacgcgctaaccgattgcaccacagagacaacctcaatcgcttgctttcatctctatatagattaagcaatcactaaaccctaggagttgccatttgctttctgcgggacaactgtgcagactacaaagcttcagaaaaccggagaggctgagtcgactaatcgtgttgttgcacgttagaaacgcgtgcattgcgtgactctgaagccagaagggcggccgaatggccttcaccctgcgttcaccctcgcctgcttcagaagccagtgcctctggaaatgcctggatctgcgaccccagcctgagccaagtagggcccaagggaagctgaactccccgacgtctctcatggtagctctttctgttcttttgcgccgccttcaggcaatcatctgttccgcttgctctcccttcactcaactcggcttcagtagatggggtcggtggggcgggagcgggaaagaggcaggggagtcaaaagggaaaacgtgaaaaggaggagggagaagcaggggagaccaggactagacaatgggacagcccaggatgcccgtgcagagggcaccggctggatgcagagaagatgggacatgtatcagatcggagaggaggaaatggggagaagatgtgagagaaaatcacaagaacctgtagctgcccaagaataaagaagtaaaaatcgcataatgtttttacattaataaaaaaaatcgggggaccaggggcggtggctcacgcctgtaatcccagcactttgggaggccgaggtgggtggatcactcacttgaagtcaggagttcgagaccagccgggccaacatggtgtaagctcgtctctaccacaaatacaaaaattagctgggcgtggtggtgcacgtttgtagtctcagctacttaggaggctgaggcaggagaatcgcttgaacctaagaggcggaggtagcagtgagccgagatcgtgccgctgccctccagcctgggcgacaaagcgaaattctgtctctcaaaaaaatatataaataaataatagaggggtggggaagcaaaacgacgggcagtaggtgtggggcgccttgggattctctagtggttagtagtctgcgttgtgcctgcagcaacctctgttctaatccgaatcctggtacagtcagactctatcttggacccactggggcgaacccacgtgtcttttggtttgcttttgattcctgcaccagctgaggcctttatctgcagccagaaagccggaaagcagggtttacccctggccccacagcgccatactgtctggggaaaagaaggaaacccaagagtacacaaacagtggcccaaagagaaaccttccaagtgctctatgcctcaccgtttagcagaaaatatcaagcaactctcaatctagctggtctgtaccttccacgaatgaaataatgtatttattgcagtctttctggttgagatatttcaaatatttggtggagcttttaatgagagagacactctcgagtgtggaagaaaaaaaagaggggatgtgaagataaggcgactttaggacagaaaaaaaaaaagagacaaggaagccatgtaaacgtttttggatgggcgtgaggcgttgtcagtcttgaaccccgttatgtcaggtaaagagcgcagcctcttctaccacaaacaccatttcccacatggaggaaatcacagggatcagcaactctagagtgagatgaagaagcttcactctgggagaacccccttcgtgaccacggtctctcccctgccaggtaaagtggaaatgagcacatggcttgcagggacagcacagcctcctcgccctggccggtcgctcagggtcaccaccctccccactgccgcccctcgccattcttccaaaccactctccaccaaagattccaccgacagtcaccccacaagacaacccaggccgcctctcagcagcggctcccgccccgcagccaccgcgccctctcacccccgcgcggttctgcccgccgcctctgccgagtctgcgcacttcacctccctggctcccgctctcccctgagcttacagtggactcggggttcttccgaacccctcttgggagtactgaatggaaaagggggagcgtgcgcaagtgcttggtagagtgtagacgtcgtgggatttgactgtggtacaatcgcttcgacgtcctagtgctgatttttccacctgccttctgcttagggcaccggcagcagttttccgtctgtgcctactccacctgctgtccttgttgggtcagcgaacatcgcctccctctaccgctcaatcagcaaacgggaccgccctcgaggacctcacccgccgcttacccccctaacaaattcgcgggcatcgcctccggtcgcctcttcccaaggcctaacgagcgccttcgctggcaacggaggtgaggaggctccgctgactggctggtgcccgtgtccggggctgccacaaacgccacgacttggcttggcctctctcttagttattcgcagctcagcccgatgggcgtctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaagattcctgcgggagggcggccagtgtaaaacaattccctgaccgggaatcgaacccgggccgcggcggtgaaagcgccgaatcctagccactagaccaccagggacacacaggagggagctttctctcccttcttctgtcagaagcgacagcttccctgagctctgggaggacttgggccttgtgagggtcgctctttgctcctggagtctctcacaaggccattccctccctgctttcttcaaaaaaagagcctgcaagcgacacaccgagggctccgcgagggacaccgaggccacgagtccgaaggcctggagcgagttgcagcgacccggccgcagctcaccactggactagagatgcgcctttgcgaggtggcagcaagtgaccagtcggtcgtgcgtcgccaggtccggagccgcgcaccaggttgccaggaggaggcgggagcgcggaggcgcccggggtgagacgggggcaccctctgcatcataaaggacccagacgccagcaccctcaacgtcataaggaatcagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagttttttcctcagatccaagagccaactggtcatcaattcgtaatttcccatcggctaagtgcgtgggcattgagctacacgcgagtctctccacctctgcggaatggctacttcggggtaggggaggggccctcccgtggattgtaaggtgtttagcagcagccgtcgcctccgctgactagatacatgccagggggttagcattctccctccccgcttcccccattcgtgacctagtgtcccagcgtggaggtgagaggcgtgtaagggcaaagttgccccctcttgagaaccactgatgcgcgttgtcctgctgtctgagcttgtgcagaggactctccagatgaaggctcaggggtcgatccagcttgagaccccctcgctcccccgcacagtcagaccttaggattggaggcttttaacatctctacatcatgagattcgaaacctttaggtcttttcttccgttctgtcctccaaatcggcctcttccgagcctgttgaccagggccagccaggcagacggctgggttcgctcaacgaggctcctctcggccctcctggagcttcaggcctctttcggttgcagagaaactttatgggccacttccttcggcatccccgggggcaggtgcgcggtgcccggggaagaagagggtttgactgcggttctcgacccccggcgaccaacctccaccccggtgggcgcgcttttccaggctcctgctggtcccactggccgggagttaggtctcgggtcagcctgagctccagagatgcccaggcccggaaggacacttaggggaaaccagctgctcactttggtcttgtccgcaacggacctcttgctgccaggaaagaaaggcgtcgagtcctgtcctgttgggtaggcggaagagagatcaaagggaagacaagaaaaatcctgggaggtttcaggatctaaagttaccatgaagtcgacctaacctcctctggaggtcctcccagtcctcccgtggctggcgatggtgaatcgagtttccgtctccagtttgccaaggcggacaaagccgacacaatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacaccgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgttccactcagaaatgagagtgtattagtccgttttcacgccgctgacaaatacataacatagtccaggacgaaaaagaggtttaattggacttacatttccatatgactggggaggcctcagaatcatggcgggaggcaaaaggcacttcttacaaggcagcagcaagagaaaatgaggaagaagccaaagcagaaacccctgataaacccagcagatagtgagacttattcactgtcaggagaatagcacaggaaagacccacccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggcttactataagctattacagacaaggcatcaggagtgacaaatagataaacagactgagttaagagacttgaaactgatccacagctatacggtcaataaatgggttttcaataaaagcagttcaataaaagaaaataaatcatttcaattaatggacttttatatggatgtggggagaccaacaatgttattctccctcacactacacacaaaagtaatttcagccgcattacacaccaaaacttaaaagttaaagatataaagcatttcaaggatagtttgtgacttgttggtaggcaaagatcaccctaccaacaagcaggacacaaaaaatacatatataagaaagacatgataaatgagacttcatcaacattagccacaccttctcatcaaaagataccactaagaaagtgaaaaggcaagcaagtcacagacagagagaaaatagccacaaaacgtgtctgacctccacaccctgcagttataattatagtggtctggtacactgcgcccagtttctgctggatggagtattttctgggtgtctctaatgagtaagagagggccccatgggatattccttcagttcccaggtgaacagtgggaaagactccacattgaccaacctcgggggcctaaaaatccaggtcctataggagggtagagtatacctggaccctgacccagacccctggatgggttgtgccaagagacccagcaagggaaaggatttcctcctgcctcaggttctctgtccttctgtggttagacgacctgaacccaactccctccccaagcactggagatggggcttttccaagggctggggatcttgctgtcctgagaacagctgagcaagggggtcgaggaggagcttgggtggtggaggagaggaaaccgggtaagatgcatgaagccgttggctataccaggcacagagaggacccactgggacccaatggcctgcatgtgaagccaggccttgggccacctcgttcctcaaaggggtgctgacttccatggggtgttcaaagggactgtggaaagagaggccttcagcccacacctctgaatgcttttcgaccacagcatgccctgtggcctttatcctgctggtgtggaacagtcagagccctgcagggctgcagagcttctgtactgggcggcatcccagcctgagtgtcagagctcagagagcaggcaccggagcaagtagagaggagggcaccttttggacagaatgtgtgggacaagagcgacggctcatccattcaggttcctcagaaaatgagagtcaggaagatgagggcgcagacctgattccctacacagggctgaaagcagacaaccggaggaagagcagcacctgggccaacgaggtagaagacagaagaccacagtctactcctgccctcaatctcaccccttcccacccacatcctccacgccccctgatcaccttcctcagaagtgtaataggaatccagattccccctggcctggttgctgcgggaggcacagtggcctgatggagcctgaggcaggtgtgggaagatgtggattgtctaactggaggttgggagttcagggtgaggaaggagaagcttggagtgcaggatttggtggtatgtatgtggctgtaggcaaaagaaagagacaactaagccacttgaaataccatgagaattcaaatttagaaaattcccagggaagtatgcatgcaggcactcatgagatccaaaaaacagctgctgcttaactgcgtgttgcaagcaagccctaaattgctgattttgaaacagcctgatgggttcacaaagacaatttctgaatagtcttaagagcagaggtgcactaaagccactgtgccccgcagctcaggatcccagaaagttctttaaggagtaagtcttacttccatttatggaagatttttggagttgtccttagtcacccccaaaaatgttttggttaggagtagaattttagatgtcatcaatttaaaaattaaaactgaaacgctggaactcatagagagataaaattaagagaatccattcacatcctgagtagaaagatttttatagaacatgacgggctttaaaaataaagaaaaaatatggcaaaatttcatcaaattaaatgctttcagaactaagattaaaatctgaagccacccaactagctggacagatggcttctttgccaaggagaccccagagaagtcttaaatactgagttcctggccagtacttggaagctcagacacctctccttatactctctccctttgtggtttagacacaactgaccagcattattgttaaaatagagatcctaagactgacagaacagagtccttacagtagtaagataccatattataaacaagacctaaggccatgccaggcaaggttaagtcatgcacccctcaacttaaagaataaactatgttctaattgccacaggtttttttcttcttcctttttttcctctagctaaacaagcactggccttgagataagcaatgctgaagcacttgcagctcacccattagcataaactgactgagccctccctacacaagccataactacagctttgattggacaagagactgatttcagtaacttccccttgataagagagcactggctgtggacgggttctggacggtttacagaggctgtgcacttgactgcctttgtgtccctacttccccttttgaagcatagggcctaattataatgtatttaaatgtcatctccaccccaaagtgaacatgggttgcatgtaacaggcttgtttactcagcatgcatgcagcaggatcccttcatgaatattcagagctcctcctattccctgttgaatatgcatatgtggcccaccacatcaacataaatccctgttcccccctcccctccctggaaacctacttttcggtttcagcaggagggtatgcctcccagtctgtgggaatggccaccttgcaggctgtaaccatttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaagatcacaagcattcttatacaccaataacagacaaacagagagccaaatcatgagggaactcccattcacaattgcttcaaagagaataaaatacctaggaatccaacttacaagggatgtgaaggacctcttcaaggagaactacaaaacactgctcaacaaaataaaagaggatacaaacaaatggaagaacattccatgctcatgggtaggaagaatcaatatcgtgaaaatggtcatactgcccaaggtaatttgtagattccatgccatccccatcaagctaccaatgactttcttcacagaattggaaaaaactactttaaagttcatatggaaccaaaagagagcccgcatcaccaagtcaatcctaagccaaaagaacaaagctggaggcatcacgctacctgacttcaaatgatactacaagtctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccctatttaataaatggtgctgggaaaactagctagccatatgttgaaagctgaaactggatcccttcattacaccttatacaaaaattaattcaagatggattaaagacttaaatgtcagacctaaaaccataaaaagcctagaagaaaacctaggcaataccattcaggacataggcatgggcaaggacttcatgtctaaaacagcaaaagcaatggcaacaaaagccaaaattgacaaatgggatctaattaaacttaagagcttctgtgcagcaaaagaaactatcatcacagtgaacaggcaacctacagaatgggagaaaatttttgcaatctactcatctgtagattcatcagaatctacaaagaacacaaacaaatttgcaagaaaacaacaaagaaccccatcaacaagtgggcgaaggatatgaacagacacttctcagaagacatttatgcagccaaaagacacatgaaaaaatcctcatcatcagcggccatcagggaaatgcaaatcaaaaccacaatgagataccatctcacaccagttagaatggcgatcatcaaaaagtcaggaagcaacaggtgctggagaggatgtggagaaataggaacacttttacactgttggtgggactgtaaactagttcaaccgttgtggaagtcagtatggtgattcctcagggatctagaactagaaataccatttgacgcagccatcccattactgggtatataaatcatgctgctaaaagccaaatgattataaataaattatatatttatttgatttatatgattataaataaatgattattataaatgattataaatgccaaaggattataaatcatgctgctataaagacacatgcacacgtatgtttattgcggcactattcacaatagcatagacttggaaccaacccaaatgtccaacaatgatagactagatgaagaaaatgtggcacatatacaccatggaatactatgcagccataaaaattgatgagttcatgtcctttgtagggacacggatgaagctggaaaccatcgttctcagcaaactatcgcaaggacgaaaaaccaagaactgcatgttctcactcataggtgggaattgaacaatgagaacacttggacacaggaaggggaacatcacacaccagggcctgttgtggggtggggggagggggagggatagcattaggagatatacctaatgtaaatgacgagttaatgggtgcagcacaccaacatggcacatgtatacatatgtaacaaacctgcatgttgtgcacatgtaccctaaaacttaaagtataataaaaaaagtcaaaaaaaagactcaattcttgaatatacaagagaacttttgtaaatcagtaatatagagctaagccaaataaaatagggcaaaatatttgaatagtcctttgcaaaggagagtttcttatatgctggaagccacaagaaagtatgcttcataggattgctcattaggcaaatacaaattaattccacactgagatagcactaactactcaccagtgtatggctacttttttttttttttttctgagacagggtctcattctgtcacccaagctggagtgcaatggtgcgatcttgactcaccgcaacatccccctctggagtagctgggactacaggtgcatgccaccatgcccggctaatttttgtattttgagtagagacagggtttcgccatgttggccagattggtctgagagcatagctacatttaacaaagttagtacaccaaatgctgacaagaatttggtgccacttcaactgtcatcgctggtgaaaaacattctagaagactggcaatttatactgatgttaaacttatactcaggtcatgacccagcaattgaaggacttccatgaatctcaagtgcacacaaagactgttataagaatattcagcacaagaattcaataaccccaaaattgagaagtgatctatgaaactacatggatatatctcatgagtataatgaatgtaactgcagaaaaaaggccagacacaaaacatatgtacattcattcatgtgaactttaagaacaggcaattgtaacctgtgggaatagacatcagaatagtgataactaagaggacacagggtgggaatcacctggacaggggctctaacaggcctttctcagatgatggcaattttctataacttgagctgggtggtgataacattgatcaaaactaaacaaattgcactaaagatttgtgcactttatgtgaactgtagcttctttactgttctcattgcttgaacctgggagacacaggttgcagtgagccgagattgagccacggcactccagcctgggtgacagaacaagactacgtctcaaaaacaataataatagtaataatttactgttctcataaaaattagcagatggggaatggaggcaagcctgtgcagaccatgacaactagtttagattttattgtcagctcattaaaaactcgtcctcgttttgtgtttttaaaaaattccactgatacagccgttttctctaccagaaaagactataaccgcattatttcatcagtggaagctacagacaaagggcccttgagaggcggcatcttcacctacgggaatttttcctgctcaattgtgagacaaagagcatgtccaagttttcctatcggccaggccgccccctagtttctgcgctgtgggctaaactccagaagctggcgcccttcagggccagaggtttactctgctctctggaggctgctaggattaaaggcaaagcaaacgacaggtctattagccacagttgcaggttagaaaacactactgtgactcagattagaacccaggttgtggcaaccacaactacaagtattaactactacacgaccacaaagcctgctgacaagcattgcacttctatgttttgaatgtaaaaacactcacactattttatctgctttattgttggacgtccgcagattttcgtgcttttctgtctttcgtgcgcttctccctttctctccccattctgctacataattaaaaaaaaaatctcatctctcaggatccgaccactgcctctacaacaagcctcctgggaggtctctttgtcccattgacatctctgccttctttcgctgctttttttttttctttcttttttgacggagtctcgctctgtcgcccaggctggactgcagtagcgcgatcttggctcactgcaacctccgcctcctgagttcaagcgattctcctgcctcagcctcccaagtagccggaatagcaggtgcatgccaccacatttggctaatttttgtatttttagtagagacgggattttcccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatctctcggggaacaccgatgggcccacaaaacacgcggaggccgcggtcgctgacgatgtgagcaaattcggttcacggtgtctggggtacagccctgagggtctactggccgcctctgcgcaaggaccagtctccgccgctcccctcatctccacgcagattcttgcccacacaccacccctttctttgggccgctgacgcctcttggacctctgaggtgactgtcctgcccgcagcttctctccttccaagagcgtcatttcttgatcctctccatagtggctcaacggtaagcccaaggtccagcacgcgaatcaggaacctgatggttcttcgggtttgcagggatccttccagtgaatagatgaaagtcacaggtaccagtatgaaaactgcagtgactcaccggaaacacttcatgcttgtcagcttgctaagctgtttgagtccaacaactgcatggggtcctgagttagtctcctgaatgtctcctgccgctactttcgtgagtgttgtcgtcactttaccttgtggtggccaagcccctaaatgcactattaggttatgcagtatgattttcagcgtaaaagacagataaagagcaacagcggggtgaaaaagaccctcttgcattggccgggaattgaacccgggtctcccgcgtgggaggcgagaattctaccactgaaccaccaatgcctctgcgtaacaaccgcctgcaggataacagaaaacagtatccacaaagacttagaaaccgttccaagcggttttttcaagtgtcgactaaaagctaacaaagacatccaaaccaaatgtgtttttacaggaaacttttactagacaacgttataaatatcaaaatagctcatttgtcggatcaaactcttaactctgaaaaaggtctttctttctacctgcattacaaacccctataataaaacatcagaaattcattcacgtttcttttttctaatcctaaatcttccatcgtcaacctcaaactgctgccttagaggttctaagaaggtaacctaactggtagtttaggtaagtaaagttcaaatccagggaggaaatcagtagcagaagcagaattagaagaaagaggaaataaaaggacagaaccaaggtagagataatgaagaaacaaaggttggtccactaagttagtcttttgtcgctggtttttttggcaaaagagtaatgatcagtctcgtaatcattataatactattatttgtctgcttgaagatgtataaagcatttgaaggaaatgtgatatgaaaagatgaagaacgctcgctgtcaatgtttccttgtttgggagaatcccatttcctaagttaatatgctttgatgtattagctatgtaagcagtagactagtttaaggaaatattgacggtcaaatattagcatattagtcttttgatgaagttcaaatagtagagagatttctttcctcaattttctctggaaacattcaactgaagagacaaatccagagttttctccatatgttgggtctgggagtcattatgactttttcaaagacaggagctgtgacatggaatcatgcttcttctctagctgagaagccaagctaggtccaggctgcgtcataaacttgagcccaccaaggaaatcacccttcacattgacctcgcagagttttggctgttctctgttctttgcccaacacccaagacacacaccagctctggccaacaaaccttaacatatgatctatatccaccagagctatatttattcccaaatctccttctaaaatacaaacctgtactttctactctcaacttctaaatttacaaaggcctcatatgcatctcagagtcacagatgctaaaacttaaccggttttctgaggattatttggggaaggggtatgcatgcaaatgtatatacataattcatgtgatttaggaatattgactctatgacttccagatgcagatttagaacctttttaaaaaatattttgtttttgttgtcttgcaaatcagccagatctgcaacttaccagagtaaagcgaagccaagcgggacccttaggaaatgcactaagatgtcatccactttcagtgtcagcctgtgaaaatacaggcgatagaagagaatgaagagaacctgaaggaatttctggaaccaaagctaatattaagcaggcctcttgctggcagaccagtggaaactgtagcctggtcaacgatctctctagattgaggaggtctaaagtgtagccacaggttcaactacttttctgtttgtttcccaacctcgattaaactcactaaatttagggacaaaaaaacaaaacaaaacaaaacacgatgttcccacgcagtctcgaaccagagacctttcatatgtgaagcgaacataataaccactacaccacagaaactgcatatgcaccaaaaaaggcaaaatatcatcatgaaaatcttaggtcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcgtccgagccctgggcgccccgtgcctctcaggagtgtggacgccgcccttccagggatgcggaccccgcctcggggccttttccccggcgccggccgtcggggctcttggctcttctcgtcctcccaggaaccgtaggactctccttgccctccctcccgtaggccgaggggcgcgagctgcgcctgtttcctcacggaccctttggcctcagcgcctcgacgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacctactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacgtaagccataggaggtatttaagagtaaattctaccctgataaagtattgcactgaaaaatttagtatgggccgagcatggtgactcacgcctgtaatcccagcactttgggaggctgaggcaggcagatcacaaggtcaggagtttgagaccagcctggccaatatggtgaaacccctcctctactaaaaacacacaaaaaaactagctgggcatggtggcacatgcctgtaatcccagctacttgggaggctgaggcaggagaattgcttgaacctgggagggagaggttgcagtgagccgagatggcaccactgcactccagcctgggtgacagagtgagactctgtatcaaaacaaaacaaaacaaaaaatttaccatgccactgttcttcaactgttctatatatgttaattatatgtccctagataaatcgtaaggtctgtgagaatgaagatagttctgcgtttcacatcccttacagcaccagcatcacagagattcacagcagatactcaatgaataattagactcatctcatcctaagtctagataggacctttcatgtcttctgttttaaccaccacctgatgtctgaatttcttctgtgttgtgatactgtggctgactgtattttgcaatcatggccatcacataaactctcatgccatcaactgatgagacccaaaacaagagaccctaagtgagagccacccagctgagcccagtcaaaccacagaaccgtgaagcataataaagtactgtttgaagtcactaagttttagagtggttcttacttagcagtagataaccaggacacataccaagatgaatgtctgtgttttcaacacaaagtgtcaataacactgataactatggcaaatagcattgagagcttaatgtatgctgggcaccattctaagcacttgtactaattttttttttttttttttttgagacagagtcttgctctgtcacccaggctggggtgcagtggtaccatctcggctcactgcatcctccacttcccaggttcaagcgattctcctgcctcagcctcctgagtagctgggattacaggggtgcaccaccatgcccacctaatttttatatttttagtagagacagggtttcaccatgttgggtagcctggtcttgaactcctgacctcaggtgttctgcccacctcagcctcccaaagtgttgggattacaggcatgagccaccacacctggccagcacttgtattaattcatgtaaacctaatatccaccctttgagatgggttctgttatcatcctcacttaataggtaatgacaaaggctcagaaaggttaagaaggttgcatgggtagtaagcatcagagctaggcagtctgattccagtattaccactatactatactatactatactatactatactatactatactatactataccataccatatgtactattactttactgatatatccctaagaggaaatccctgagatctggtatctcccagatactgggacatcatcctatgccctcctgcttgcctacctgtcttttccacagacctatatctaccatttaaatcagtgtccttgtgaatacccagacatgttgtttcttccaactgcctgagctaccctacaccaagcacaaacttacacattttcaatccagaaagtgcccagacagtgccatccttacccaggccacgaggctgatctcagctcctcagccagcttcccttctagtcaattttttgggagctgggcctccagctgggatactctctggatgagactcttcaggtcctttttggcctgaagtcctggagagtagaaagccccagtgccatcagacagccacacctcatcctcatcagtgacactatgaggtgaagacccctccagggtgtcaagagctctcagcttccagggtctttccagactagatgaataatcacttgtaactgagagggactggacccggctcttgaagttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttacaactgtgtgaaaaataggcaaaggaaaataagactttgaataaatatatcagcatgttaacatcagtgtattggggcagtggtagtcagaatgagaactaatccacagcattttacccgatgccagacactgttctaaagcattttataagaatttactcatttaattgacattagtacctgatggggtaggtagttcctttattactattttaacatttgaagaaactgaggcataggaaagtttacaaattgggatttgaagcaacaagtctggccccaggatcttttctcttaactgccacactacacttcctcaagaatgagagagactgtgtttttcttctcttctcgttttgaatgtggtgggtggccctatagttgtagtccttttataatgcaaaccaaaattatttttaacttatggtttgcatgtttccaaaacctcatgtggtctctaagtaggccttagtatttctataataatcagttggatagaacttcatatgattattattattattagcagtatgccacaaactcattgtagaaattcaaacttatactcagcctcattttgggtaagagttctcctattaacctcctgtcctcctcttccccactacttgtcaggtgtggaattggccaacagcacccaaatgtgacagctgactccagggagggaaggtgagccccacaccctgtgctcttaccgggactggtggattcctcctgttcagcctcattcttgctttgaccacaagtctcatagcccaggtcctggaggtccacctggacctgcttgctgtcctgcttcagcaagggttcacctgcgtgggaagagacagcaggtgttacagaatgtctgaatttcccacatatgccctgagcctcaatggcacataccctaaccttgtggggcagggagggcagatccacagtgcaagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccactgaagctggcaagtgctttatcagcaggggttcaataaatgttgaatgtaaaacatggctgattactttttattttcaatccaacaaatctccatttctggtgagaaaatcttgccaaaaccaaccaagcaaatgcataaaagtatatcaaaaagaaaatgaaagcttccctgcctcccaatcccacttgcttggtttcagctattatttattacatggaggaagggggctaggcacccaggaagtcccaagtcctgttctgacaatcatctggcctccctgggcaaagggaaaagagggaaggcaaaaagaatataacattactgtttgcagaaatttccccttggtacaggaaactctggtaaactgagagagtatgttttccatgagggaggcctcaagggctcttctctggccctaagcccaaactggattttgcctcattttctaagatgcaaaggaaatggtaaaagttgatcaaaggagagggcagagaaagaaagaggacgactcctccatctcaggtccaccttcctcggtgttgcttgagggatcagaggaaatgcatgaacagaggtgcgtgggaactacggctgctctgtgaactcagtgccctccagttacgagctattgtgaggttccatgatgtaatggcgagcgctttggactctgagtacggtgatcagcgttcaagtctcagtgggacctttctgtataatgccaatgatattcctattgctccctaagcggaatgggggaaattgccccagtcatggtcacccaccgtccaggccactggctgtgtgcaattggagtcctagacccagcgacccagcaagacccctcccctctcagggtgaccctgggcctccaggtgacaggtctcctccactgaaaaggctgcgtcccctcaatcctagaccctgagttttcttttatacatgtcattgggccattgccctgtgtctctttggaagaaatgacctatatgaaaaactttacttccgggattccctaattccttcatcccttaggacggcgcagtttttcagctcctggtcttggctccagttctaatgcacacgtttcattttattgtcatgggatcccctccaacaggctaccactggattcctgtccttggggtctctgtggatggcaaccagatgctgctcttgtcccagatcctgacacctctctccagggaattgcctcccttagcctcctaaatcagccaatatttagatttgggcctgggatcgcagcaactgtggagaacagaggttcccgatccctggccagcctcccgcagtgaaggggagaggagcacagcagctgggaggggcaagtctggggccctgggcaacccccttcttcctgcccagactctgctccaaggagcagttgccttaggaccagatcagatggaaactcttttgttctcttctcatcagcagaaaaatttaggcaagagctctggaggacgttcctagctcctaaaaatggtgtggccaaatctctccagttttggaaatgcccaaggttaccaagtattttgagggctcactttggagcctctgaaaaggaggggtgagggcccatggaaggtacctgagggatgcaggggagagaggggaaagagcagacaggagggaggagagaaggaaggaaggggagaaagggcgtgtgagggccaggagccaggattcaccctgacagttcagtgactgctcccttccaacaagcttcccactgtggcaccttctagcaggtggtttccatctcttattgatgtcctaagaccttggctctatggaacggttctgttctatttgtctggcatgagtcctggcaaagtttctttttcaccatttgggggatgagatgggggtatataggtttgcaagtgactaggagctaagtcaggaacttgtggagccactcagagtcaactgtcaagtagcctccttctcccattcccctgcaggacgattgcctgcaagacagggcctggagaaggccagggcacccaaggccacagaaatgcccagggatgagtcccggctggagatgccttggctgaactcactgtgtacttccagggtgcacagggcaggtactctgggggtctggccgggagactgagcaaggggaccagggaggttatgcagaagacttctgcacagcaaggcagacattcttcttggagcccccaacccaaatcaggtcttccacctcctcttcctaaagaccctttactgcagtcattcttttactagaactgcaagtttatagaacatagatttcagtgtgctcatctggccaaccatcttcagtggccaatgcccaaggtaacctccctccctaccaagacctgaactcagagccttacctaaggagaagatgtcctgttctttctttcccaccagaactgccctggcccagaccccatttctgtctggtgaccaggacagtcccctcaccagtctcccaggttggggagggcagattctcctcagctccctgcccctgagagaccccaacagccttgcgtggctccagcccacagagggctatccatggcccatatctctcaaaactctcccctcccactctgaatccaccctctactgcatgctcccctcacagaacagacatgggtttttttttgtgtcctcgttttgcctacccataccccagattgacttttctgtctcagaactacctgtccctctttggacagtgtcttcttggtactacacatgaagatgtcctgctctcccctgctcaaggagagagtgcctgacctgagctgggcccatcagatccagtacttacccggaataggaaaaagatggagagggtgaccaaagattacaaaaatctctgaagcttatccacttgagagagagtccctgaagatactggcctttcatttcctgctatgtatatccagtgtgactgaactctgaataacatatacaagttataataatgtagtagttggccctcaaactaggacacaaacatgttagagggtaaggtagtgagaggcatgtttgggggtggtggtgatgagcaagtatgtgaaggagagatagtgcctacgcttgaaaatcaaaaaggaataatatctatttagacataaggagataaataactaaatacttgcttctatgtgatgaaactctgggagtacacaaggggactgctgttttactaaacaaattttccagtctatataactttgataaggtatccaaataaaaaaattcctttcccatatatgtatgtgtatatatatgtatttgtatacacatatatgtttgcatttttgtattttgaatataaatttttatagagtcctgtgaacccctcttttcaattaggatttgagtttgatgtcatgcatgcaatgtgatcccactgtgtgactacagaaatgttggcaaaagtaagttcagaggaaatggtaggcaagtacttcccagttttggccagaagatggagaaaaaaagaattctcataaaatattaaaagtatgacttgttacagcttcttttcatagtaatttggatagaaattagcaaaatcagaaatgtataaatactttggtctgacaattccatctccaggtatctacggagaaatagacaagtgatgcacgacagatacatgtgtcagtctggtctctgcagttgtatttgtaataatacacattggaacaatgtcatggccatcggttagagaatgtttgaagaatgacccattcatatcaggaaggacgtttcaaagatcaaagcctgatggaaatgctggaggccgtgacgctgataggagctcatgcgtgttgaccaattgctacgtgacaggcattggctccacgcttttcctgcactgctcgtttaaacattggacaaattaagtgttctgatttagcccattagacagatagaaatggaagcacagaaaattaatgggtttatctttaaacgcgagcagattaggtttttcacccagggcctgtggcttcaccataggtgtgattcaggttctgttgttctccactttaggaattcccagtattccaaatatgagaagctgagaaaacaaacaaactcaaaactctaaaaaccgggataagtaagggtagatgtttgctgggtgtggattaataatgaactttttttgcctcaagcaacaaagaggcaccttggaaaatagacaagagacaagaagaggagaagcttgaagatatatttggtccaaggaagagactcttcagagggaagatcacatcagctagaaacattaatgcgactggatgggctcaaaccaccgacttttcagtcaacttccgacagcactaacctagtgttccagagaccctgcttgttaaacagtgaaagctgttgctcaattgtgtcatccataattgtcaaatattgtcatttagtagcacaaggaagtattctctgttgccaagctagagtacccataactcttctgttttgttgaacattcttccccaccacaaaccctctttagaagactggtggctcctaaaacattgaggccaacagacctgtccttgtgcatgtttgggcattgatccagggccaaatcagtgggagactcctccacgcacatgccaggtccccaggtgacaactgcagtctctggatctgaggtcatccactttcccattcctagctcacctcacccatcatgaagcctggttagtattgccagagacccgagtgggcaggtgcccgcactaaagacagaacctgctgtgtgcccactttgctgatccctccatctttctagacaaggctttgtgagccaaggactttgggtttgctcacaaggcagcccctcacctagtaggcattagttcattatgtatagtatacgtatatgtgtatgtatatgtatatgtatatgtatatgtatatgtatatgtatatgtgtatgtgtatgtgtatgtgtatgtgtatgtgtatgtgtatgtatgtgtatgtgtatgtgtatatgtatatgtatatgtagtcctcaggttgtattccttaaatatatataatatatgtaattccttaaatatataattttaatacaaaatttttaaaagattcctttcataaacatttacaataacaccaagaaatataaactacatagcaaagatgtgaaagccagccaggcgcagcttcaaatcctagcgcttaggaaggccgtggcaggagggtcgcttgagctcagaagcttgaaactagcttaggcaacatagtgagacctcatctctactgaaaatcagaaaaattatccggctgtggtggtgtgagcctgtagtcccaggtactcagtggatgaggccctaggatgtcatcggcctgagaattccatgctgcagtgagctgtgtgatcttgccactgtactccagcctgagtgaaagagtgagatcgtgtctagaaacaaaagaagaaaaaaaaaaaggtgtgaaagcctatatattgaagattaccatgtattactgagagcagttaaagacctttggaatagagaacgttccttcttgcatttcaagattgcttttgttttggggggacacttgctgttttttaggaacatgaagttcttctcaggcattcctgtaaaaaaagccactttttgataggattgtattgagtctgtggattgctttgagttgtatttttatcttaaccatgttacaacttccaacccatggacacaagatgtctttccattgatttaggtcttccttagtctcctcgagcaatgttctgtagttgtctgtgtacaagtactgcaccttcttgaacaaatttattcccaggcatattatccttacaggtgctattataaatgaaatcattgtgtcagtttacttctcagatagctcattgccatcacaatggattgtttgctgaaagtttgctgaattcacttattaactctgatagtgtgtgtgtgtgtgtgtgtgtgtgtgtgtgtgtgtctggtgtctgtgtgcatgtatgtgtgtttgcctttgtatgtattgtttgggattttctatgcataggatcacaccatctgcaaattgagatcattttgttttctgttcaaaaatattttttctcatgtttatttttgaaagataatttggccaggtgtagacttgtaggtgacagtttttctttttttaagtactttattgcaaacttcttgtttgtaaaatttcctatgagaaatcttatgccatccttatatttagtgctctgtatgtaacatgttcttttcccttttattacttttaggatttcctttttatcactggttttgatggatttgattaaggtgttccttggtgaagttttctgcatgtttcttgttcttgggataatcatatttctgtaatatttgaagtttatgatttctatggagcttctaaatctttcatccagtatgttttaaatatctttttctctcttctccactacctgcccttcagggattccatttagccctatactggggggtttaaagttttgatgctgatggtctttatatgttttcaagtcatttgttaatgtgtgtttcatttatgttagtttcaacttctattccttctagtttaataatcttctcttctgcaatatttaatccagtgccttcttccatttcacactgtaaatcatagtttttatctacagaatttgatatttaaaaaatcttcaacctctccatttaattaaaatacaattatactaattgcggtaacgtccttttcttctatttccaacgtgtgtgtcaatttcaaccagattattagattcttcagtatgtgtcatgttttcctgcttctttgactgcttgatattcttttatttttatttatttgtttttggggggatggagtttcactctcgttgcccagtctggagtgcaattgtgtgatctcagctcactgcaacctctgcctcccaggtactcaagcgattctcctgtctccgcctcccaagtagctcagattacaggcatgcaccatcatgcccagctaaactttttgtgtttagtagagacagggcttcaccatgctagtcaggctggtcgtgaactcctgacctcaggtgatccacccggctgcttgatattctaagatttgatgctggagctttggtgtcaatgctcaaaagtgcccaaagacaccactcaacctcagtgtctatgcacacccaagcttttgcaacaggagaggtagagacagcagagatgaatgtgctacaacatgctggtagaaggtaccccaattgtgcttggggcttcctatgcctcatagaataatgtgccttccttaatttttcccataagaaccaccctacttcatgccctgtctctctgtccaaacaccaggacagccctcagaccagtctcaaccacccaatggattgacaaaggtccaaatatgattcagtggagaaggcattctcttgtcaacaaattgtgtagaaacaactggacatgcatatccccaaaggaaaaagattcacctgaacctcaatactgactcaaaaactaactcaaaatggattatgcaactaaatataaactataaaagtagaaaaagtatagcaggaaatataagacaaaatcttcacgacgcagttaggcaaagtgttctttgttatcaagaaacacaaaccattaaagaaaacattgataaattcaactttataaaaagtaaaagtttttgctcaacacgagacagtattaagagaacaaatataagctgcagattgggagaaaaacaggggaaatgacaaatgtgacaaaggacaagtgtgatagttacttgcacgtgtcactgtgactgagcaccagggtgccgggacattcggccaaatgtgattctggttgtgttccagagagtgtttcacatatgattaacatcgggatgggcagactaagtgaagcagattgccccccttaacgggggtgggactcatgcaatcaatcaaaggtcaggagagaattaagaggcctaatgggaaacaaatgctttcctgggtatccagctttccttccatcttgggaatttcagcctccataatctcagaaacaaattcacatatgtatacacacacatatacatttcataggtatgtggctaagattgtatttttaaaagttcagccatgagatgattggtgaagccagccaatgaataagggtgtgttctattatatgactcagtcttcttttgtacacgattgaagttctgcatttgaagtaggaggacaggagagagcaagtccacctaggatgataacagctgaatttctcaacagacacttcaaagccctaggcgttaacttagagagtcaaaaatcccacccataaccctgcccctaaacgccagggctagggaacactgtggccctcaggtgattttgtttcacttggtctgggagccacacaagggcagagggagcaggaaacactaagcaaatcgaggccaggacagcagggagggcctgttcatgacagaacacaggtaaaactatcctcagaaagagcatgtggagaaacacagatcatgcctgagacctggtggattagagcactggctactggggaattgaaaggaaggggcttcaccatgcagaggaccagaggtgccagtcttggaaacgcagaattgctgggagatggggaggcatggacaaaggaagcatcctctggagactcatggtgaagagaacaaatgaagtaactggcagaaattataggtcctggtagaacaaaatagaatcccacaatgagaacatacagcatgtatgtcccgcaaggaagacaatagctcctaaaaatgcaagaaaaatcattttgggcaaacaccttatatccagtaatgcgatccatgtatcaagaccacgaggaagattattaaacatgctaaactcagcgagacctgattccctcatgaggactctgttaaggatgagtaccactcagcaagtgatgactgtgacattcacttttgaacagctcatgagcattaatatatttaattgtggatctaaaccaaaaaccaaggtgtgggcaagatgacaaccacagaatgtcactggcatatgtttaggttcaaataccattatgagaagtggcaggtaaaggaggtaggaaaaagaaaacacatcatgtaactgactgtcatatggaaatatttgacgttgaaagtcataatttaaaatgtataaaccaaatattagaagtgtgtctagttcaaaggggggaaaactatgaaacatttttaatcaatatcaaacatgagctacacaacccttcctaaatgccagaggcacacacagacacacacacacacactctcacaaagaatataaatatctagaaccaagaaatggagtaaatgcattctgctacatatggtaaacatagcctacaaggtggaagagattagaaaataaacagggaaatggaaatgtttttattaattcacatcagtacccaccaaaaccaatcagcataacaaaagattataacactgaatgtaaaaaacaatccaacagtccagagtgataggcaaaagcttttaattgtatagattaaaataactttggacaaaaattaaaactcaggcagagaatgttttttttttcaacaacacacactagcaaaaacaaaggcacagtaaacattgaggcagaaagtttccagcgtagagatatgaatataataatagacacaggcagggatgattaataaatgataaaatgtttacaggatgatcattggaatacaggacatttctaattttgaaaaccaccctcccaaatacttcattataagtaaggtgtctctaaaagggacagatctcctagacccctccttaaccaagtaaccagtcctgatatcatgataatgctgatggacaaactagaccttctctgcccgcagatgggctaaggttggaaactcacagcattgtctctgcagtgttcccggcaaaacgtttaggctgaatttaatcatgaagacattttcagacaacttcagaatgtagatcattgagccagagagctgacctgtcctctataaacaagtccatgtcaccaccatcaatgacaacaacaaaaagatgaggaaatatttggggttcaaaataactaaagaaatgcagctatattatctttttactttttttgaacccaaaatatctcttctcctttttgttgtgtgatttgtggtgatatggactatgtgaaggagacaggtcagttgtcctgctcagtgttctacattctgcagttgtctggtaattacctcctatgaaactcaggctaagcgttttctgcaagaacatggcgttgttcatattctgcaccggcagagtcctgggtgacatgctgtctcctgccagcggctcctgactcctgttctctacaggatggaatcgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttaaagatggatcagctaaaacaattcaacactgaagatacaaagaatgaggttaggttcattgaaaccagggtaacacctttggatgagctaaacacaaagatgacactgaccttgagcaggtatagaagctcagagacatgactgcaaaatgaaatccctgaggaactttgtagctacccagagataagtggttcaaattaaaatgtctgactgatcactcccggcatgtgctgcacagttatgtgaacgtgtcacacctaacttgggtccattgtcttcagactgagcacagggtgccactggcatggtctgagaataggaatagagccatgcccactgacccatcctatgtctgggcttccaaatggaactatagtttcattcaaatcttcacgtgcctataggtcctgcctgcaggaatgacatctctcggcttagtaagggctgcttactgtgggaatatgactcccatctggaagaccaggtggagacttgttcccatcaaagtaagaaacctattgtccacgtcaagggcgaagctgatgtgctgttcctcaaatgagtaaaacacacttctgtagtgctggaatgagtcaggtagttcaaagtacattgacggagtcgaataacatctatccagtgagtcctgcaagacttcaggctcttccacttccatcagcatgccgctgagcctggaaaagcagacaaaactaaagaagcagccagggaaaatcagacaccacagagccccactagatttcagaagtaacgtaaggaagtggtaagaaaagaaaaggatagatccattagatccattaatgaggtaaaaaaaaaaaattattgcctttatgttgggatagaaaagggccaggtagaaaacaatgaaagagaaagacagagagacagagacagagacagagacagagagaaagtgagctagtgaattggccaggtgacatactggtaagggagtaaaaggacactctgagttagtgccctcatgacacacagcacactgcgatcatgaaaagagtgagctcaatagttttccataaaatatgctcaaaattcgatgcagtggccatgagagtacagcttttgaagtatggtcatcctatggtacgttagtaaatgataaggggaggaagaaatggaaacctaaacatctactgcaatgaaaaccaacagcaatgacagtaggagtaattcagccttcgttgaaaacatgaaatcaaacacactctggtttccctcaatctgttgcctccaggtgttaacacagaattaagcatccacaattgctgaaagttacctggggcatggtgggttttgatcttcttccccttcttttcttccccttctccttcttttcttcgttgatcttcttccccttcttttcttccccttccccttcttttcaatttctgcaataaattcagacatggacagacacattaagctgattcccctacacacataacaatccactgtctaaccctcacacagggacctcaggctcctcagcataagaataggagactgtgagagatatatttcaggaggcctgaaggctggtcatgatagaaattcctcggtttttctcccagaaactgtgggtaaaatgtccctattctagtagatcgttatcccaatatcatttgtcccgagtttgtgcaaacagttatgccatatttttccaatcaatttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagagtagaatcagagtgccacaggcatggcctgagactaggaagagagccatgctcactgacccatcccatgtctgggcttccagttagaactagagtttcattcaacctacatgtgcctataggtcctcactgcagcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggcaggcaggagtcaggctgttcaagacaactggaaggagttgaataacatctatccagtgagtcctgcaagacttcaggctctactgcctccagcagctccctgctgagcctggaaaagtaggaaaaagtaaagaataagccagggggaatcagaaaccacacagccccagctacatttcatggctaacataaggaactgtttaaacagaaaaaggacagatccattaatgaggtaatgaattattgcctttatgttgggatagaccagggccaggtagaaaagaatgaaagagaaagacagggagagggagagggagagagagacagaggagaaagtgagctcagcgaattggccgggtgacacactgacgaaggggtcaaaggacactctgagttagtgccctcgggacacacagagaacagtgatcatgaaaagagtgggctcaataattttccataaacttgcttaagattccatgcagttgccatacagcctttgaggtatggtcaacctacagtaagttagtaaatgataaggggaggaagaaatggaaacctaaacatctactgcaaggaaaaccaacagcaatgtcagtaggagtaattcaaccttcgttgaaaacatgaaattgaacatactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacgcagggacttcaggctcctcagcatgagaataggacactgtgagagatcttcttcaggaggcctgaaggctgatcatgatagagattcctgggtttttgtcccagaaactgtgggtaaaattccctattctggtagatcgttatcccaagatcatttgtcccaagtttgtgcaaatggttatgccatatttttccaatcgatttaaagcaaatgcccccaaatggttgctgggagaaaaactgcaatattcagccctgtctcatcaaatactcagattcttcatggtagcgaggattttagatgctgaaattagagtgaaggatgaaatctacaagatctacaaaattgagacaaaatcagagttgtgtgaatttgtcacatctgcccagatccaacatcttgagagtgggattagggtgccacaggcatggcctgagactaggaagagagccctgctcactgacccatcccttgcctgggcttccaagtggaactagagtttcattcaacctacatgtgcctataggtcctccctgtggcaatgacatctctcagctcagtaagggccatttgcagtaggaatatgaccctaaccagaagactcagtggatccttatcaccttcatagaaaggtactcaccatccatgtcaagagcccagccaacacgctgttgctccaatatgtaaaaggcacttctgtagggctggcatgagtcagtcagttcaagataacctgaaggagttgaataacatctatccagtgagtcctgcaagacttcaggccctttctcatccagcagctccctgctgagcctggaacagtgggaaaaagtaaagaataagccagggggaatcagaaaccacacagccccagctagatttcatggctaacataaggaagagtttgaaaagaaaaaggacagatccattaatgaggtaacaaattattgcctttatattgggatagactagggccaggtagaaaaggatgaaagagaaagacacacacacacacacacacacacacacacacacacacacacacacagagtgagctcagtgaattggccaggtgacacactgatgagggagtcaacggtcattctctatttgtgctctcaggacacacagtgaacagtgatcatgaaaagcatggcctcaataattttgcataaaatgtgctcaagtttccctgcagccaccatgagaatacagcttttgaggtatggtcaaccttcactaggttagtaaatgataagggtaggaagaaatggaaacctaaacatttactctaatgagaaccaaaaagcaatgtagtaggcataatttagacttgtctgacaagacaaaatcattattttcagcatgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacaggtacatcagtctggtcagtgtgagaacaggagactttgagagaaatattccagcaggcctgaggtcaagtcttgagaaaactggcttgggttctttcatgagccttgggcaaaattaccctgttttggaatgttatcttccctatgtgctctgtcctaggtttgtgtacacaaatgagcaactttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgacggacagatgagctaaagcaagcgaacttagaagacacagaaaatgggaataaattcagtgaaacctgggccacatctttcactgagaggtagacaagggtgacacttgccttgggcaggtaaagaaccacacagacatgctttgggaacaaaactcataaggaattttgtagctggcaagagacatttaattcagatgagctgatctgacagacaactcctggtcatgtgctgcatagtttggtgtgagcttgccacacctgccttgagttcaatgtcgtgacagtcagtccaggttggcacgggcatggcctgagactaggaagagagcaaagctcactcacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcaccgcctatgtcaacagccatgcagacttgctgttcctctaatgagtgaaatgtgccgctgtaagacttgtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactagccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacacagtgcagacacagatcttgtgtattaagggccccattttcccaatattttgatataatatatttaccttttcaatttcttttcttgcaaaaatactagccaacatactaccaacagataggaagaaagcatatatacatctctccctggatttaaacacatgggagagaataggcaacaccaagaaatccctgtttgagggtctggagtggacttccagcaaactccaacagacctgaagctgagggacctgattgttagaaggaaaactaacacacagaaaggaatagcatcaacatcaacaaaaaagacatccatcccaaaaccccatctgtaggtcgccatcatcaaagaccaagggtagataaaaccacaaaggtggggagaaaccagagcacaaaagctgaaaattccaaaaacctgacatcccttctcctccaaaggatcacagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggccaaccagaatgaacagtgtagagaagaccttaaatgacctgatggagctgaaaaccatggcacgagaactacgtgatgcatgcacaagcttcagtagtcaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgcactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagtgcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatgtatatatatttttcaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttcgttttttgtccttgcgatagtttgctgagaatgatggtttccagcttcatccatgcccctacaaaggacatgaactcatcattttttatagctgcatagtattccatgttgtatatgtgccacattttcttaatccagtctatcattgctggatatttggcttggttccaagtctttgctattgtgaatagtgccacaataaacatatgtgtgcatgtgtctttacaacagcatgatttataatcctttgggtatacacccagtaatgggatggctgggtcaaatggtatttctagttctagatccctgaggaattgccacactgtcttccacaatcgttgaactagtttacactcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaaccggtaccagccactgcaaaaacatgccaaactgtaaagaccattgacgctaggaagaaactgcatcaactaacgggcgaaataaccagctaacatcataacgacaggctcaaattcacacataacaatattaaccttaaatgtaaatgggctaaatgccccagttaaaaaacacagaatggcaaattggacaaagagtcaagacccatcagtgtgctgtactcaggaaacccatctcacatgcagagacacacataggctcaaaataaagggatggaggaagatctaccaagcaaatggaaagcaaaaaaatgcaggggttgcaatcctagtctctgataaaacagactttaaaccaacaaagatcaaaagagacaaagaaggccactacataatggtaaagggatcaattcaacaagaagagttaactatcctaaatatatatgcaccctatacgggagcacccagattcataaagcaagtcctgagagacctacaaagagatttagactccacacaatcataatgggagactttaacaccccactgtcaatattagacagatcaatgagacagaagctttacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaaccacaacaaactgtcagaccacagtgcaatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagacacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtccattttctaagagtgttgctgcaatacggacttatatcaccagataacatggacattaaatgtttagaggcatctatacatgaaacacacatgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgcaactgcactctagcctgggtgacagagcaagactccatcgcaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttccgtcctgatttcagggtgactgtgcagctaagcaagctgacttaaaggagatccggatgaaagctgagagcagtgaagcctggggaacaatatttccaaatacaaaggcaaggctgccagcttcctgaaacaggcatagaaactccatggacattgttcagggacagatgacttaatcacagatgacaagagatactgaatcgaagctaggaggcctgacagatactgcctgtgcacctcctgcactcaggtgactatgagattgtcacacttgcctggggtcgagtaacttgatactggggactggcagacaaaggcatgacattagctgagaaggacaaaaaaactccctgatatctgtttagaaacccatcatagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttcggcatctccctgatgagccaggtgggacagagatgacagaagattaaacacagagggattggaccccagggagtcctagctggttttgacaggcggcattaagagagtggtcccagaaagcaaaatggaggttccctttaagggggaacatgcaatcctgttctctctgcaacagagcatggctgccatgggaaccagagaggaagagagcagctggtgttcattgcagtggacagataggagctgaggaggatgaagactcagctatccctgtatggtgcagacatgacactcggcacacatagagaaacatgacagctgccgcaccctgtgtctaagctgggttatatttcacatactgtggccaagcaaatgcgggtttttggcccatcatagatgccagagagggtgtacctcctagatattcttcatatgttaccatccattacttgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggactttggcagctgtcgcccccatcctgccagatctgattcccaggcacaggcttggtgtcctgtcacagtttgcatttcaaacctaattctttctcttagaagcagacaaacttatcccacagtcctctatgcatcagaagatttcaagcctccaagtggcttctgctgtgttattcagggacattctatccatggggagtgctccagtctgaagcacttcctaccacgaaacgccaccacataaagtgccttctccaacatcacacggcgaggggcttcatctcattttggaaagcagttttaagtgttcccacatttgaatgcttcagacccttgcaagagacaatttgccatggagagagagaaactcaggaaagacaagtcattcagtcactgacagttactaagaacattgccgaaaagacaccctgggaaccttcattcttagtccagagctcttttcactctaacaagcctgctcctatcgcagcctccttcctgtcctttaaaactagatagatgctgcctcttactccaaagacaaccttccatcaagggaggagggacaattgcaatactgtgacctccaaccccatgggtttcccaactccgttcttacccaggaagtcctggtcatgtcatggccacataagcttagtggcaaaaaacaccattgatacaactgtcattgtgaaagtatggaggtctggagtctctcataagcctggggttttgggtcatcagggcctatggccaccttacctgggctgagcttttggacaaggtgctgtgccagtctacacccctcagccagctgttcttggaggtcctgcccctgggacttgtctggctcatccggagtgaggagggcctggagatgctgattcaatgagcaggaggcatctctcccttcccgtaacttctcccttaactgggtcagctctcgttcctgagagtgaaccaggactttatattgcctaaggtgagacggtagagaaaatttaagagtggaaagggttgagtgatccgctcaaatattgcaacagagatttctgagacaatgtcctcaaggagacctccaagcagaaggtcagcacatgttggaaggaatgtctgtggctaagagaaagaatagaaaatggtttacaggtttcctctgtatcagagagggctcctgcaagatcctcgatgatgttccattcatctttcccttctgtaaacaaaagtaggtgtcttcctaattccatttcaaaaagacatcctttcagtccctcactctggccatggacatttccatgtgaaaatacacatagtgcatcttgcggccactagatacaaagccatgtacagaaatgaggccaggtgcagatggggcgaattgaaaagatgaaagaagaaaagaatgacagggtcgagaaggcaacattgattgagtgaaagaatgagaagacgcagtcagtcagaaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgcttgataaatacttgtgtgttgcgagcctgccatggcaattcctgcccttcccctggcccagcttagttcttaagtctccccactgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgaggtctttgcactcttcattttctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagagaacctcaatggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgatggtttcccttttactgggaatttcaaggacaagtatgcaaaagattttaaaaatctttgatttttaaatcatatcttcagttatgattttaagaatcatatctgaagcataaagtgtgacacataacaccataaggccatgaaggaaatatgcccaaatgttaataaagtttgtgttaatttagaaacagcagaatgaagaactaatagatagtgtttactgtgtgctaataaatgttctaggagattgacaagaaatagctcatgtaattcactgcagcaatttacagaggtaggtattattgtagtaccctctgaacaggtgaggaaacagggacagaaaagacaagcaacttggatggagcccaggagacaggcccacggtctctgctctgtacactgcactgctatctccacacattctcgggtgcgatctttcttcctctttaggaacaagactctgtgccccaggaagcaggacttcactctcaccaagctacattctgcttcttattcttatttttatttatcattattagtattatttttttaacagtcttgccctgtcgcccaggctggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgtttcccaggctggtctcaaactcctgacctcgtgctctacccgcctcagcctcccaaagggctgggattacaggagtgagccaccatgcacagcccctactccctgctcttgatgctgtcacttatagatagcacaggttctattaggagcagactcctcttgaagcccctcagagcaggtactggctactatcaccaagtttccctcagagtcactagaacagagctttgcatattgggcctcaacagaaacttgaactgaataaaagttcactagtctcagacatttagaacaacagactagatgttatttgtctgcaggatcttacatggtacagagaggattcttgaaaacatgattgagcctcttggagaaaacaggtcattctgtgcctgtgtcagaaatcaataaatggcagtttaactctagtcccacccccacctgattgcaaacatggaaagttgctaaatattttgggacctctgtcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagcggcagccttgtctacttatttgaagatgatgtttccctggtttcactcttgtcatctccagtcttgatctcctttaagtcaacttatcttagctatgcagtcaccttgaaaccaggacataaacacttctacacttttcttgcttataagtttctataaagcaaggcttggccctgagatttttaccccatgagtggccaatgtttctgtgtagcacaaaaggtttcattttgcctttttaatttttttcttttttggttttttgttttttgtttgagacggagtctcactctgtcacgcaggctgcagtgcagaggcacaatctcagctcactgccacctctgcctcccgggttcaagcgattctcatccctcagcctgccaaacatctgggattacaagcgccaagtaacatgccagctaatttttgtatttttagtagagatggggtttcgccatcttggacaggctggtttcgaactcctgacctcaggtgttccgcccaccttggcctcccaaagtgctgggattaagatgtgagccagcacccccggtcagagacttttttttttttttttgagatggagtctcgctctgtctcccaggctggagtgcagtggcacaatctaggctcactgcaaactccggttcctgggttcatgccattctcctgccacagcctcccgagtagctgggactacaggtgcccaacaccgtgcccagctaattttttttttttgtatttttagtaacgacggggtttcaccgtgttagccaggatggtctcgatctcctgacctcgtgatccacccgccccagcctccgaaagttctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaacaatatgtgcgtatacagcctgtcctcagaattgatcttccatagcctagacagaggtatgagacacaaggaaaatagaggctacctgggagaatgtttacagcatcctgacattcatcatgagaggattctctgtctacaaccagagctgagttgactttgtcttcctcaaaggtgatgttgatgttcttgtgaggctggttggagtcacaagggccgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccacaccctgtgtctaagctgggttgaatttcacatactgtggccaagcgaatgcgggcttttggcccatcatagatgccagagagggtgtgcctcctagacattttcatatgttaccacccattacttgctcctgagtattcagtgttacctgggggcagatgattccagtactttctcagcctcctcaacttgaacatcttcatcctcatcttcgtcattttctgtaaatacaaaatgttcgttcagatatttcccacttcccattctccaagcacagtcagcccaatgtgcacagagacatgaacatctatgtgtggttcagcattgtactgaaaactgtcatgttttatctttcacaaaatgccctggcatggtttcctggtccatcgggcaatgcatttctgatctggagggccaccatcaagatgtggccaaatattgaaaagaccttttgcttcccatatcactggaggcttgtgcagcctctctctggactttggcagctgtctcccccatcctgccacagatctgattcccaggaacaggtttggtgtcctgtcacagttcgcatttcaaacctcattctttctcttaggagaggacaaacttgtcccacagtcctctatgtgtcatgagactgcacaggccctccatgtggcttctgctgtgttattcagggacattctatccatggggagtgctccagtctgaagcacttcctaccaccaaatgcccccacatcaagtgccttctccaacaccaaacggagaggggctgcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgccaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtgtagcagaaaataaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaataatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcaacttgcagccactagatacaaagccatgtacagaaatgaggccaggtgcagatggggcgaattgaaaagacgaaagaagaaaagaatgacagggtcaagaaggcaacattgattgagtgaaagaatgagaagacgcagtcagtcagaaggtggttctcactaagggtaagtggggtggtgatggcacaccattttgagtatactgagtgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccccacctgcccccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagggaacctcaagggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggtcatgaaggaaatatgcccaaatgctaataaagtttgtgttaatttagaaacagcagaatgaagaactaatagatagtgtttactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccacggtctctgctctgtacactgcactgctacctccacacattctcaggtgcgatctttcttcctctttaggaacaagactctgtgccccaggaagcaggacttcactctcaccaagctacactctgcttcttattcttatttttatttatcattattattattattattattattattatttttaccagtcttgccctgtcacccagagtggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgttgcccaggctggtctcaaactcctgaccttgtgatctgcccgcctcagcctcccaaagggctgggattacaggagtgagccaccatgcacagcccctactccctgctcttgatgctgtcacttatagatagcacaggttctattaggagcagactcctcttgaagcccctcagagcgggtactggctactatcaccaagtttccctcagagtcactagaacagagctgtgcctgttgggcctcaacagaaacttgaactgaataaaagttcactagtctcagacatttagaacaacagactagatgttatttgtctgcaggatcttacatggtacagagaggattcttggaaacatgattgagcctcttggagaaaacaggtcattctgtgcctgtgtcagaaatcaataaatggcagtttaactctagtcccacccccacctgattgcaaacatggaaagttgctaaatactttggtacctctctcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagtggcagccttgtctacttatttgaaaatgttgtttccctggtttcactcttgtcatctccagtcttgatctcctttaagtcaacttgtcttagctatgcagtcaccttgaaaccaggacataaacacttctacacttttcttgcttataagtttctataaagcaaggctgggccctgagatttttaccccatgagtggccaatgtttctgtgtagcacaaaagattgcattttcctttttcgatatttttctcttttggttttttgttttttgtttgagacggagtctcactctgtcacgcaggctgcagtgcagtggcgcaatctcagctcactgccacctctgcctcccgggttcaagtgattctcatccctcagcctgccaaacatctgggattacaagcgccaagtaacatgccagctaatttttgcatttttagtagagattgggtttcgccatcttggacaggctggtttcgaactcctgacctcaggtgttccgcccaccttggcctcccaaagtgctgggattaagatgtgagccagcacccccggtcagagactttttttttttttttttttgagatggagtctcgctctgtctcccaggctggagtgcagtggcacaatctaggctcactgcaagctccggttcctgggttcatgccattctcctgccacagcctcccgagtagctgggactacaggcgcccaacaccgtgcccagctaattttttttttttgtatttttagtaacgacggggtttcaccgtgttagccaggatggtctcgatctcctgacctcgtgatccacccgccccggcctcccaaagtgctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaagaataacaatatgtgtatatacagcctgtcctcagaattgatcttccatagcctagacagaggtatgagacacaaggaaaatagaggctacctgggagaatgtttacagcatcctgacattcatcatgagaggattctctgtctacaaccagagttgagttgactttgtcttcctcaaaggtgatgttgatgttcttgtgaggctggttggagtcacaagggctgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagcgaatgcgggcttttggcccatcatagatgccagagagggtgtgcctcctacacattttcatatgttaccacccattacttgctcccgagtattcagtgttacctgggggcagatgattccagtactttctcagcctcctcaacttgaacatcttcatcctcatcttcgtcattttctgtaaatacaaaatgttcgttcagatatttcccacttcacattctgcaagcacagtcagcccaatgtgcacagagacatgaacatctatgtatggttcagcactgtactgaaaactgtcatattttatctttcacaaaatgccctggcatggtttcctggtccatcgggcaatgcatttctgatctggagggccaccatcaagatgtggtcaaatattgaaaagaccttttgcttcccatatcactggaggcttgtgcagcctctctctggactttggcagctgtcgcccccatcctgccacatatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccacggggagtgctccagtctgaagcacttcctaccaccaaatgcccctacaccaagtgccttctccaacaccaaacggagaggggcttcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgtcaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtatagcagaaaaaaaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaagaatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcagaaggtgattctcactaagggtaagtggggtggcgatggcacaccattttgagtatactgaatgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccctgcctgcccccatggggtcccctcacctgagctcctcagcttgcttgagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcagaagccaggtccatcccaaggacaaaactgtcccccgtaccaggctctaggcagggatttccacatctttactcttcagtctcctgactttctggcatcttatcctccaaaatttaaagacgaagaaagagaaattcaaggcacatcaaggaagttgacaagatgattcaaccacaacgaagtggagtcagaactcacagcccctgaggtctgactctgaatgcggggccactttcccaagacttgcagcctctcctctgaaacactgcactggggcatgaagtagtgatttcttgtacagttgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggccatgaaggaaatatgcccaaatattttattagtatgacaggcagcatcaagatttagattagttgtgttaatttagaaacagcataagattagtttgtgttaatttagaaacatcagaatgaagaactaatagatagtgtttacactgtgccaattaatgttcaaggagattgacaggaaatacctcatgtaattcattgcagcaatttacagaggtaggtattattgtagtaccctctgaacagatgaggaaactgagggacagacaagacaagcaacttggatggagcccaggagacaggctgagggtccctgctttgcacactgcactgctgcttccacacattctcgggtgtgatctttcttcctctttaggaacaagagcctgtgcaccaggaagcaggacttcactctcaccaaggtactctctgctttttatttttatttttgttttatttatctttttgtttgtttgttttttgatgagtcttgccctgtcacccatgctggagtgcaatagtgcaatcttggctcactgcaacatctgcctgctgggttcaaaggattcttctgcctcagcctcccgattagtggtgattacagttgcccgccacgacgcccatctactttttgtatttttagtggagatggggtttctccatgttgcccaggctagtctcaaactcctcacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacagagccttgcctgttgggcctcaacagaaacttgaactgaataaaagttcactagtctcagacatttagaacaacagactagatgttatttgtctgcaggatcttatatggtacagagaggattcttgaaaacatgattgagcctcttggagaaaacaggtcgttctgtgtctgtgttagaaatcaataactgtgagtttaactctagtcccacccccacctgattgcaaacatggaaagttgctaaatactttggtacctctgtcttccaactttaacaaaatgttaaaatacccatttctgttttcctagaagtacaggaaggatgaaattatttttgatggagagagcatttagtgtctcagagagaagacaggacatcattcatcactttcatgatggtgagcctatagatcttactgtatttcttctgtcggttggccaggaagccggccagttgagttacaaaacatttctctttgaggtttctgaactgctgtttgttctctgccagctgggggcgcaatttctcgttgatttctaaaatgttcgtctctgccttctcgctggaccaagggccagctgataccaccatgctgacgtttgtggcagaagaggtggagccagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctgaactcagagctgaaagcactgccagtagctcagactctgataagagtgaggtagactgtggccagcgtgccaggtaaccgtctgcagttgcaataacagaattagaaggtgggggtgtcatggaatcttaggagccctgcattccaattgcccaggctttcctgaaacacaggcaccctagtctcacctgagggtcaccaccaatggggatcattccttcagcattcactctcagtattcgtgtacccttgtgatgatgccacagacccgtgtctttcccaatacatctaagcatattcctcactgtttatctcttgtctgtacaacatcatcaaggcagaaacagtttcccaacaggttgtattttcttaatggtagtcatgaagtcaccccacctgctctcagttaaaacagagcttaaggcctttccacaggtgtaagatatcaaacttttagcctgccctgatttcctctgggtcttctgcagttttgtctgtatccactagaaagtgaatgaataattcatttgtaaaaaatgttgtctttcctgtctcagtattcttcttgctgtttcccattgttatgttgatttcttttttctcactggggcaccatctttgcttttcattacactctagaccagtttgacatccctatgtccagagctcttcctctatgtgggttgatttggtttttgatgtcactgagcgctacattttatacttgtcacttatggatgtcattctagtgtcacaagagctcttttcaaggtatcaagtgatcaaaatcatttatatagagatctcctgaaaacatgtgtgaccatctatcttgggaagtttcataaacctgatgctattttgttgtttccattttgttttcccatatactgaaaagaacagggccatgagcggttcttatgcaatatggtttgatatatattttgttgagatgacctaacaccattgattttgggttgcattccactaacagaacatggcaagatcaaggttatggtcacggttggttggtgatcctcagtgttgcagtagaaggtgagtttgagatgagaggaatgagtaggaaagagtgatcccctgaaccacctcctcgctttctcagctttcaccccacctaggttttgtgagcctggaacttgggagactgttctgtagcccaggtctcctaagattggctgctggacttgcctgagttgagggtgcggtgggttgaccctgggctgcccagcattcatgtggtagtgaaggaaggaggactggatcaatcccatttcaaagcatgtctctctgcactccacactgtcctccaatgacactgtaaggaaaccgctttaagacgtatcaacggctttaagtaaatgtattttctggcatctgggagacctgacattctgtgtcataatgaaaatctgtcatgtttctttattttaaaaatgataaaactgcaggttcacagagttacatggcttacttgaggtcacacggggatgagttttcagcactgccaataaaagcaatcacatgaattattcagtaattattcataggatccatataattcagtaaatattcacataattatttactagttgttcattgaccaattcgtacaaggcattttgctcaaaactgtgtttatatttggacattgtatcttcatcataatcctgtggtaatgctgttatccgtaagtaacaggtaagaaacctgaagaggagggatagcaaatcatgtatttggacatatttcctttttttttttttggtttttgtgatgctggaagaatgaccagaatgagtcataggaagagtatacattcctgtagtattttccaggacagaggtgtgacctcctagagtactgggaccaaaattcccaagtgtctgcaaccttgctttaacagtatgggagatcacctctatcacctggaattcccctggaactctggaatatacaagagaagtatgagacttgggtcttcccttggctgtgtttaattcactcttctatggaataccaatgattctcactaagactggccttttcataagcacaatgtgcattttatggagaagattttacactttgctctatttagaaagaataaatatgagcagtggtttaggttttatgccctggacttaatatgtttctgattcctgttttgagattaaattctcatgtaaatagaaaaatacttattatttctcataaggccaagtttgttattagtttgagtttttgaagatgaagcacaaacttttgattttatctttgtctgtctctgtcagcgccactcgttgtctctcagtatgacctggacttgcccctgcacttacccttgtcctgctgaaccatctccatgcactgtccaattccatcagtgattcgggctccttccaaggctccctgaaaagggcacagagatcaggacattaggcacattccggacacaaaggcaacccatactgtagagtgggcagctgtgtttccacttccctaatattccagtgatgtcctcaaactgaaaggaacactttccctttttaggggtctgttcttcatgtctcagtgcctctgatctagtcaacacaactgtcctgaatgtgaaagaacttgctaaatttctagtttcttgttaggtggctaaaatagatttataagacttccttacttacccatgactgctgaagtttgaattcttagcagtacgattcgttttcttgtaaggtgagcagcttaggaaagattggccatcttcctgtgcaaaaagaggcaaacttaatttctactcaaagcatgcttgaatttggaatcagggcttccactcttccgaagttggagtgtcactgcgacaggcatgtgtcccgaagggctcgtgtctctgctatactcaaagtttaaatggagcccagcaagccagatgtcctttacttctaggttccctcaacagtttctcctccgctttagagaccgcattgaaaatattcttgttctgctgttgtgttttggctttggaatgatgtgatgcagctcaatgggtcccacccccaacttgatcaaagtaagaaacagctgggaaagtcagtgcaaatacaagttcattgtcctccttgcagggattctgattcagagggctcaggtggggcctggaatgtttgttaacatgactcagatgtgcagtcaatttggggactcactgacagcattgaccttacagtttatgggatgattctttctgtttggtgatgaagaaactgaggcacacagagtctgtaacttgcccaagttccccttgttgtaagtcctggagccagatctcaggtggaccagtgcttctctcccctatacctcatttctgagaaaaggaaatcttctgcaatttgacttctttcatctaacacatttcctcacaacatgcagccagcatcatattttggccacttactattaaagtgagatgcttttttttttttttttttgagacagggtcttattctgtcacccagggtggagtgcactggtgattatagatcacggcaatcttgaacttctgggctcaagcgatcctcctgcctcagctttccaagtagttggaactataggcacacatcaccatttctggctaattttatatttttcatagagacaaggtcttgctatgttgctcaggctggttttgaacttctggcctcaagcgatcctcccacctaggcctccaaaagtgctgggattacagaagttagccactgaacctggccctgaaatgcttttatttctttcttttttttaatgaaaatactggacatggagatgtggaaagacaccttgctttattacttttgttgttattattatttctacagtagaatttatacatcacaaaattcaccatttttaagcatacatttcagtgtcttttaccatattccaaaactttcgcaaccatcgccactacctaattccagaatattttcataatgccaaaaagcatgcctgtacctatgggcagacactctccaattccccccttcttgcgctctctgacaaccactaatctaccttctctatatattgatgtacttgttctgggcacttcctctatatggaataacaaagtgtggtattttctatctgcttcttagaatattgttctcaagtttcatcctttctagcctgcgtcagtacttcaactttttatggccagataatattccactatatggttataccacattttgtttattcatcaactcatggtggtttaagatgtttccactttttaactattaggaataatgctgctgtgaacagctttgtacaggtttttgagtgaacatctgtttttcattttcttggttataaacctaggagtgcaattgctgcatcatatgtcactttatgtttcactttttgaggaactcacacactgtttactaacttcagtagctatatcattttagattcccaatagtaatatatgagaattccatattctccatcacttttgaaacatgtgttgtctttatttttttcttaagtcatactgctgggtgtgaagtggtatctcattttggtttaaatttacattttcctaatgacgaaaaacattgaacatctttgcatgtgcttcttggccatttgtgtgtttcctttagagaaacctctactcacagctttttttccccattgttaaatgtggttgtcgtttattgctcagttatatgaattccttatacactctaggtactagacctgtgtcaaacatacaatttggaaatagttctcccattatgtggattatcttttcacttccttgacagtgtcctttgaagcatacaagttttttattttaatgaagtccatttatctatttttcggttgtttgtgcctacttaaaaaatgtctaatccaaaatcacaaagatttgtacctaggtttccttcaagacatcgtcttttgaatgagaactttcctgggttttagaggagggtggacattgtttattgatgcctcctgtccattaccgatgtttctcttgattgttattcatatgctcaccacccctccatggagcatccatggcctgtgacagagctctggggactgatatccttccactgactttggcgctggtgagagccctggtcatgtgattcagcttggccttaacccgacccagttgcacatattcctcaggccctttagagttgaagtcgagacctctctgagaacgcttgccagcccatgctcttctaaggctggagcaaacttcctccatctattccagacagaggggactgcaggggttggactcactcaagatatctctggtgttagaaagaagacctgtttcaggctttggggaagattgttcaatatgaactaggtcctctctaattatttttaccgtatgtgtgacttctttctagaaacaagggaagaatatttatgttagaacattttgtctattctttgtcaattgttgtttatctacaattttaacatggataaaggagagttcagtgtcaatatattcttaacaactaattacggctcatgtccaccgccatgcgatcatatttaaatctgtcaactatcctgttacttaggtattatcctgttcctgatgagaaaacaaactcagaaagattgcaaaatttccctaggtcacaaaactagtgaggagaggagtaagaattagatatccgttccttttggccttcaaagctaaccttgtaccattagatcaaactgatttacatacttttgctggaattagtctcagacttgtggttctcacttgattttcccaaggaaacagtgtgccactttaatatcatttcaaactttgaaatttaaaactctttttattatacttttttgtctttgttctattccgttgcttttggtttcttctcaacggatccctcttatttatatgctaaatatttgttacctattttctgtcaattttcacctttttgagtgtttgttatctgtctgttgtatgctaacagtttttcactgaggtaaaatttgcgtagagtatactgcaaaaaaacctaaaggcacagcttaataaattttaatataattataattgtaaagtaacacccagttaaagacagagaacattttcccccatgccacaaagttctgatgtggtccttgccagtcaatactcatcccccaaatgaagaatatattctgaatgttgtcactgccttagcccctttgtgttgctggaaaggaataccagaggctgggtaagttatcaagacaagaggtgccttttgctcatagttctgcaggctgtacaagaagcatggcccccgcatctgctcctaatgagggcctgaggctgcttccacttgcagcagaaggtgaaaaggaaccagggtgtgcagagatcatatggcgagagaggaagcaaaagagagcaaggaaaggtgagaggcactttttaataaccagctcctacaggaactaagagagtgagaattcactcactaccttctcccagggtggggattcatctattcatgagggatccactcccatgacccaaacacctcccatttacccccacctccaacactggggaccacatttgaacatgtgatttggaggggaccaatatttaaacttagcagccaccatagattcattttgcttgatcatgtgcttcataaaaatggaatcattttggctgggcctggtggctcatgcctgtaatcccaagactttgcaaggctgaggcgggcagatcacctgaggtcaggcgttcaagaccagcctggccaacatggtaaaaccctgcctctactgaaaatacaaaaaattagccaggcatggtggccggtgcctgtaatcccaggcaccagatatgtactggtatctcatatgtacaggacatgtactggtatctcattgttgtattgattgatgttcctgatggctaaactgtagagcatcttttcctatgctaattgaccattcatgtatcttcttttcttaagtacctattcaagtcttttgagaaattgtttcattgtgctgtttatcttattaaacttatatatatatacatacatatatatacaaatacactctaaaaaacccctttgttggaaataaatatatctcctatattgtggtttcttttaatgttctcttaatgttccctgtttggagataacgatagataatcttcaaaaaggtgaatatacacacccacacccacccacacacatacacacacacacacacacacacacacacacacacgtgagccaccggatccagcctgttgaatttatttctaagcacaacatgtatttagatgttacttgaaatgaaattgtatttttatttcattttccaaatgctcattgctaatacacagaaatacaaaagactacttctattgagcttatattctgcaacattaccaaactcactaattacttttggcagatttttatagatttctaggattattaacatacacagtcattatctgtgaataaagacagcttcaattctttcttttcaatcttttcaatacttttatttttcttactttattgcattgatttagatctctagtataatgctgaattgaaagaataacaacagatattctacttttttctctgatttaatagaaaagcattcaatcctatgccatttaatataatgttacctctgagtttttttcaaatctacccttaatagggttgaaagtgttgccttctcttcttatcatgctgagagttttctggggtttgtttttataaatcatgaaaaaagttttcaattgtgccaaatgcttttactgtgtatgacaaggtaatcatatggtttttctcttttgccctgataatacataacattacattttcttaaatataaaaaagatttcttgaatcaagctaggacagtttttttaattataaacttttaacaaatatattgaaatataacttacatgcaattgagatgcatgaaagtgtataatcattaaagtgtataattttaagagtttgagcacactatacacgagtcaaagagaaaggacagaaaatactaacgatggctcagcacatgtggtctatcttgctgaatgctctatgtgagtttgagaagagttatttgttagctgttcttagatgtattttgcttaaatatcgacctggctaacatgtgtcattgattgtgtgaattaattttgttctagtgggcagtaaaattactgtctgatcactttggacttatgtggactggttcatgttttattacaacggattcatggaaagcccacagcatttcccaagaccctctaatttggcaggactcaatcaccaatccacccctttgtgaatttgtcagggtttgcttttaggctttagcaggttggtctacaataggccttattgaaaagtgtgacacttattcctaaagcacatccattctagtgtctcagttggatacctgggtgctaatgaggtgtgcatgagttcttcccaccatggatggcagaaactccatcatacattccccaaccctcctccacctcaagtacctctggtccaaactcaatttcatagcagccacccctctgttaaatctgttagtcttttccttgtgcaggtagagtccactccttgataagtatgcacatggaaccccacatagactttgagagctgcacctttgatcagctgtctcctcactggtgccctgccctgcagattgcagttgcttcagccgtcttgaactctgatctctgccttctcagctcagtgagctgccctgccctgagtggactctagctcactatgcagctgctgagaaattctccccaaacaactaggaaatcatggggcttcccccttaagttttctcttggactgcctgttgtacactgctgaaaacaattttacgtttgtttatggaggcagggttagtctgatatgatttattctaacagacagaagcagaaatctgttatactcttttaattactgtgtctttataatattatggtagacagaatcctaagatgacccccagtgatctttgctcttatataatcacttcctcctgagtgtagacaaagctactgaggagatgtcactcctgtgattgtgttacaatttatggcaaaaacaagttaacagatgtaatcgagatcccaaatcggtccaatttaagatagacagattatctgatgagcttgacctagtgaacgtgagttccttggagggactgaggacttcctggagagatgtgaagtgcaggagggtttccatgcagggcgatcctcctctgctggctggaggaagcatgcagtgggaacatgggaggcctctaggagcagcgagaggcccctggctgacagccagcaagaaaacagagatctcagtcctacagtcacaaggaactgaactcagctgacaacctgaggaaacttgagaggaagttcttccccagaacctccagaaagaaacccagcctaatttcagcctgtgaggccctgagaagaagacccagagaatccaggcctgaacttctgatctgtggacactgcaagaaaataaatcattcttattttacgccgctaatgcttgcagtaatttagtatgcagcaatagaaaattaatacaaataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcaggcttctgtcctcagaactagagtttatcagtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctccattcggagggtagcagctgaggctgctgattcgttaggcctcctgcagctggagatgcaagtagtgcattttcatggccaccgcagggccctcagtttagcattcttcagagccagcatccaacaagccacagaagctctgagtatttccctttcttcagtcacccacataaatggcttcagggccttctggggaaggcctgaaggaagatttacagcatacacttgtggcagcattgaaggcttcactcttcctcaagggatccaatctcccctcagtcaagaagctccaggtatctgaactggatgccaggtcataaattcccactatggtgactccatcaggtctctgtcctcagaactagagcttttctaagtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccgctgttcccctcacctgtgcatttcttaacgccttggtgaggagaatgtctctggatcttccttgatgggagctaaaggaacaaaggtaaataatgctatgggacccactgagaactggggctgtggaagagtggccactgaagtaatagacagatgcagctattgccagatactcagtgccagagcagggagggacagggaagaaatacggacctcaccttcctctcacttccaggatccatcgggggccctccattgctaaacctaactagaagtgtgcacgcacgggagccagggatgcattctaggagggacgagccccgagtggcatgagacaggatggaaatgagtggacagtggatctgtgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctctcctgtaggttgaaaaggaggaggtactgaattacctccaaatgttcctctggctctgatattctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctcaccttcgtacactaatggttggaaggtacaacagcatatgcactttgggaaaaaatatctggcatattcttacagaaacaaacaactacctattctatgactcagtaattcctaagcatttatccaagagaaactaaaacctatgtccagaaaatgacttatacaagaatgttcatagcagttttattcataatacaaaaaactggaaacattcaagtatctgtcaatacaagaatggatcaataaactgtgatacactcattccatggaatggctaaaggaacaaactggtgacacacagaacaacatggatgaatctcaaaaacatttggagtgcgatagaagccatacccaaaaaagtgtgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgttattctatgtctgtcacatcattccacagtaggggcagataagctgtttagaatggctaaaattcaaaaaggtgaacacaccaaatgctgtcaaagatgaggagcaaccagaactttccatcgctagtggaaatcaaaagggtacagtcactttggaaaacttaagttcactcaaaatcctgcacagaagtacttacagcaattttattcatcatcgccaaaacttggaagtgcccaagatgtctttcaccaagcgaaagaataaacaaactgttgtagccatacaaggaaatctgattcactgattttaaaaaacaagttatcaagccatgaaaagacatgaaggaacttaaagtacataatgctagaaagaagccagtctggaaacccacatactgtaccactccaactctaggacattcttggaaagtcaaaaagatagaagtagtaaaatggtgagtggttgtcaggggtggaggagaggaggacgcgtgaaatggtgaagcacagggaattttcagcagtgaaactctttcgcatgatgctgtattggggatttaggacattatgtaattgccaaaacccataatctgtgaaactcaaagaatgacctctaatgtaaactatggactttagttgataatgacgtatcaacagtggttcatcaattgtaatgaatggaccacactaatacaacatactagtagggaaaattgtgtgctggaggacaggggagcctaggagaactctctgtattatccactcaagttttctgtaaacctagaactgttctaaaaaataatgtctattaactgtttttttaattaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagtagagagaatgaaaaggaaagaaaaagagagagcatgagagagaaagaagaagaaaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttgttcattcatttaacaaatatttatttaatatctgttgcatgccaagcaaggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtctaaacaggatttgccttcagattgcctgtgagataaaagagagaaatcaaggttaacgttgagatttagggcttcggtaacttgaaggatggagctgccatttacggagactgggaagacccagggaagagcagattgaaaggtggtgggaactagaggtggttgggtttctgtcatatgtaatcaacagtcctgaccagcctgggcaacatagtaagaccccgtctgggaaaagaaaaaaggaaaaataagctgagcatggtggtgcacacttgtagtctcagctacttgggaggctgaggcaggaggattccttgagccttcagttagcggttagtgagctatgatggcaccactgtactccagcctggggggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagctacacatacgaaggtttatttttcattgacatgtccttttatggcaggttgactgtgactctactctatacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataaaaattattaaaactaaaatggccaggtgtgatggctcatgcctgtgatcccaacactttgggatgccaaggtgggaggatcatttcagcccaggagtttgaaaccagtctgggcactacaggaaaaccctgtctacaaaaaggagaaaattagccgggcacagtggtgcatgcctgtagacccagctactaaggaggctgaggtgggaggagtgcttgagcctgagagatcaaggctgcagagagccatgatcataccactgcactccagcctgggcgacagagcgagacactgtctcaagaaaaaaaaaaaaattatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttgcctgaacacccaacacatctgaattaccaacacccatatgtagccaagaaactggcaatcatttataaattatcacctatgactccatctgctctacgcacttattttttaaattttattcatttatttattatttttatttgttgtagagatgggatctcactatgttacccaagttggtccagaaacagaaacagacccacactaatttcataaatcagatgaccatacagtcattcgatttatgaaaaaaagtgccacatggtgcggaaggaaaaggatggtcttttcaataaatggtgctggatcaagcagacacatccatgtagtaaaaagtgaatcatagccaggtggggtggctcacacctgtaattccagcactctgggaggctgaagcgggcagattacttgagcccaggagttcgagaccaacctgggaaacatgttgaatccccatctctacaaaaaatatgaaaattagccaggcatggtggcacatgcctatagtcgcagctactcaggaggctgaggtgggaggatcacttgagccaggagatggaggttgagtgagctgagatcctgccaccacactctagcctgggcaataatagactgaggccctgtctgaaaaaaaaaaaaagcaaaaactaaaataaaatcgttataaggttaacacagaaaaatgtgttcatactcttaggttaggcattgatttcttaaacaggacacaaaaaacagtaaccataaaggaaaagattaataaagtataatttcattaaaatgaagaatctcaggctgggtgcagtggctcatgcctgtaatcccaaccctttgggaggccgaggcaggtgtatcacttgagcctaggaattccagaccagcctatgcaacgtggcaaaacccatctctactaaaaatacagaaaacagctgagtgtggtggtactcccctgtaggtcccagctacttgggggctgaggcagggggatcacctgagccttgtgaggtcaaggttgcagtgagctgtgattgtgccactgcactccagcctgggcgatggagtgagatcctgtctcaaaaagaaaaaaaaaaaaagagaatctcccttcatgaaaaaacaccataaaagagtgaaaacgcaagctacagattgaaaaaagggaaatgcaatacatataaatcctagaaaggaggcatatccagaataaagtattacaaatcaacaggaaaacaagcatatcaatgaaaactggataaaaagatttaacaggcacgtcacaaaagaggacatataaatggcaataaaagatactcaatctcaatgaaaccacactgatatattactgcacccctactagaatggcaaaataatttttaactgacaggtatcagcgaagatgtggggtaaccagcatatccctgctaaatggtacaactactttgggaaaatgttcaacaatatgtaatactaaagttttatcattcatatacctctaaaaccaacaatgccacccctacaaatataccccagactagtaatgttcaatttcttgatctgtggtggttcacttggtaaaaattcattacttttttttttttttttttgagacagggtctcactctgccatccaggtcggagtgcactgccatgatcacggctcactgcaatctcaacctcccgggctctggtgatcctcccaactcagcctaccgggtagctgggactacaggcacacgccaccacacacagctaacttctgtatttttagtagagaaagggttttgccacattgcccaggctggtctggaaatcctgggctcaagtgatctacccaccttggcgtcccaaagtgctgggattacaggtgtgatcactgcgcccgggccacctgcacatgtaaaattgtgaacttctgtatacttcagtaacttttccaagatttctttgacgcaaagttctcagaaatcttaaagctagcatttcagaatagaaaaagtagcttctggttcactagtgaaattttaccaatagaatttaaaaacaaaaagctactaacgcatatcagctcagaacactaccagcagatcttttctttaacttcctgaagcactgggattcattcttttggcaaagaaaggatgaacaacactgtaacccaaagaaaagataccactgccagaaaagacttcttttcgaaagcagctctaagcaaaagataggaggaaaacaaggaagccaggccaaacgtcttggttaactctccgctgaaaggacgccacatgagatgatctaagaagccagccagccagccagacgcagggaaatcacagcaactctttggagtgcaaacagcaaccccacaatccaatctacccgaaatcctgcggttcatttgaggcttgccccgctagtcaggaggtgattcagtgatggctacaaatgctgctcatgtgcatcctggagctggcacacctggcttgcccatcaccagcctggagacaccgccaggagcagaagcccggaggccagtaaagaccccaactttgcaagtcaggggcgcgagcgcgctcgcctctcaggtccgcagagggaacggatttctggcctggagggtggggtgcggggtcagtgtcctctacaggatataggaggacgtgcccccgaagctgctccgtccctccaccccctgggatgccacagaacacccgccagcgagtttcttccccagcgcccacgagagttgggctgcgggcggcagcggcaggcgaagaatccagcgcggggaactcaggccccggcggtgcacgaccccccacagcccccacccgcccccgcgctcgcgcaacaaaacttgccacggccgcgcctcgacccagctgtgcgcccgcgggtcccggattcaccgcccgcccagcctggcgcggcgccctcacctcagaaacgctgggtggacttcgcgtaacttcccattcacagggcagccggcagccgcgccgccgcgcctcggcccagctcctggcgccgcagatcgcccgtcccgcgttcccaaaagcaccgcgctcgctcagaagctcgggcagcctcgcgaccctcacctacgcctcccagtaccgccgctgtctcaaccgccacccagcccctcgcctgcgcctgcgcctgcagcccactggctcctcaggatcccgatgggcgtgtcaggataacccaaggcgcaggcgcggcggggccttaaagggacccggcggcctcttctgcacaacgggttcgagcaggttaggggccgcgcaggcggaggaaaggagtaacccaggggaaggaccgagtgcagcggggacggggaaatccctctctcccctccgcctgtctttcaaagcaccagccctcgaccctccaaatcgctggtttccccggccacttgaacagcccctgccaggttgaagaggcaggagacacaccccctctggggctggagcgaccccgcgcttaggactgcaggcctcgcgctgccgcaccgccccgaatctgacttccaggcacgggcacgcggtgcagtcgggcaggcttcagaagagcccccagctctcccagaggtggccttaggtcactctcaaaaagaataaccaatgtgtcaatggcacttgtagttattttctaatttaaatttattaacagattttgcagatgggcttccactgaaataagcctttgagaaaaagaaaaactttttttttcaacaggattagaataccaagaaataggaagtaaagccatgccgtccacccagctaaaaactttgaaaacttgatattttatctaaggcaaatgtttgcataactttaggtcatgccattatttaaagtcaatttcagttaacaatttcattgcaactgaatctatcttgtataagaaaactaagatacatccctgataatctacctctcccctcctatactccatccgtcagcaaatcctactggtttttaccttccaaattttccttgaatctgtcctcttctatctcctccgtcaccaccctagtctaggctgccttcacctggggagtgagggtcgagggactactgacctagtcttcttgtggtttacccatatcccctttatcgcctctctaatctcaacacaacaggcagagtggcttttccaaaatataatgtgaccgtgtcacttcccagcctaaagcacttaaacaccttcccattctcttagacaaaacctcctaactaaccaagccccgaatggccaggcgccttgcccacttcttcatctcttctcactactcagaccaattctgttctgctctctctgctccagccaaactggcctcttttattccctatttaccagcttcctggcctccacagagcttttgctcatgctttgctctgtgcctggaaagttcttctaacccctattcttctgagaacagctgtagtctccacctctgaaaagcaccttctgacctccctatggtggtcccttactcctatcacattgcatgaaactgtaatcgggtggttattttggtgaattttttactatcggctacgtaagcccagggtttggttttgtttgcttcatgatttgtatttccacatttgttaaatacatatttgttcataaatgagaatgatggatgctagaagttgaagtaaatttggcataaagtcagagaaagagaaaatgtcacaatctgacagttggagtcagaatgtagaaacttcagttatattaaaactgattttatatcgttttaggctgagttgtcttaggatgctttgggtaacctttaaaactgagttctcaaagagccttgtataaacacctgaattaataatgataagccatggggtggcccacataaaactaataacattggttgctttaagagaggaagactgagccaggcacagtggctcatacctgtaatccaagcactttgggaggccaaggcccgcagatcatttgagctcaggagtttgagactaacctgggcaacttggtgagaccctgtctctacataaaatacaagcaaaattagccaggcgtggtggcgggcacctgtactcccagctatttgggaggctgaggtgggaggattgcttgagctcaggaggttgaggctgcagtgagccatgatcatgccactgcattccagcctggatgacagagcaagatcttgtctcaaagagagagagagagagagagagaaatgaagactggtgactggtggctactggtgggaaggagatttttactaaatgcccaaaaggtttaaaattgtaacttttttatttcaaagtctgtgaagataaatgacacaaaagagcacataccttcccatttatttgaaattctagaaaggggaaaattaatctgtggtgaaaaaatcatagcagtggttccctctggcaggggattgactgggaagttacatgagagaaatttctgggtggtaaaaatggtctctgtcttgatagggatatgagttatataagtgtattcatttgtcaaaaaacatacagttaacatttcaatgaatgtaaattttaccttaaaaactatacgaataaatgcaaatttaaaatctgctagctaacacctagttgagtactcagtgtctatgggcattggccgaggctatacatacacgattttctttagtcctcataccgtcctcatggggtaggtattattatcataacccccttgcatatgaagaagccaaaatgcagtaaataccaaataacttgcctcgatttatacccctggaaaatgcgggaagagctttaaacaccatcagtcaaatgccagaagttgttaaacattagactctatagcacttctctgaaattatagtatttttggtatatgtatatatatatatatatatatcatctactagatcaagagcttcacaatgattgaaatcatagtttgtctttttgtttgaggtttatgtttttattttacttcattattttaaagactgagtctcggccgggcacggtggctcatgcctgtaatcccaacactttgggaggccaaggtgggtggatcacttgaggtcaggagttcgagaccagcctggccaacatggtgaaaccccatctctactaaaaatacaaaattagccaggtgtggtggcacgtgcctgtaatcccagttactcaggaggctaaggcaggagaatcgcttgaacctgggaggtggaggttgcagtgagccaaaattgtgccactgcactccagcctggccgacagagtgagactccatctcagagaaaaaaaaaaaaaagactgagtctcactatgctgcccaggctggacttggactccttcattcaagccatcctcctgcctaggcttcacctgggactacaggcccaatatttttgtcttaagtttctaagcagtcccaagactttgcacagtagctgttcaatgtattttgagtgaatgattaaaaacaagcttgatgtcgattttattggtacaatttatatttacatatgtaatatttatatgcttttatatatttatgtgtgcatgtatataattggtactaacttagcactgctgtgcctaagtgcctgagatgcatctcaaatgaataggcctgaggagagaagcttgtgtcattagctctgaccctgcagcactaatcctggtttacccctttctttcagtctccctgagcacaatttatttgctgaaaggccacatctcactatggagtgaggatcaagaagtaaaggtctgaaagagagaagctgcggggctggggagactgttggtcggagaggcgtcgggggcccaaggaaaagggaggattgtggggaggaatcggcgtagagatgagaggagcagcagagacagagtctcacgcagaggtgtgcccagacaccctgaaccaagttacttaacctcgtccaccaccgtggcacccgtggggtccgtgggcccgtcggtcttccaggagggattctgtgtccctgttattgtgtgtcaacatgtgttagcctgatatttatatttttaatgagagaaaacgaactctggaatttgcgaactgttttttcgttttgctttatacctcttggacactccttccgaaggattgggtctcaagggcagtggggtgtgactacggtagacagggctgattaattttcatccaaaactctttggcggattcccctgctctccgcttctccggtctaacagtagtttaaaatagaagatcagcaacatttggagagtttttttctttgcattttaatgataaacttgatttattccattccaaaagttttcttattctgaggttgtctttctatattttgagtataaaacaatggccatactatgttggaaccaccaaggttcttctcttcacttgttcatttgtaatgtctctttataatctgagaatttcctgagcaaactgggaactgttatacataattccttgtttttcaacattctttgtaaacaggaatcaggattggggatggggagggagggaggagtaggagtcctgatttgtggaacagaaaatcatggattacttatgtgatggagcaaagggtttaaaaactcttagcatccccagatttccccttttactgtttgctgaagaaaattctgtctttgactcccttccttaccctctccgggcctgtgagaagcttcctccctatccagtttatttcctcctctgctccccgacccaccccccacagccccctcctctttttcagtgaagccgctggaggaaagtcgggtttgggagaagacccacacaggcaaggacagcaggagaacactgacatagttacactcttgtcaccagcacttttattaagacgtgaaaagacaaagacaacagaggagagcagagaataatatctctgtttcagctattccaggatgttatgccaattatccagagtccttgatctgatgtagtaaagagctagggacattttccctgaaggctttgattgctggcaaaatctcattaaacgtgtatacattcataggttggccataggatggataaaagaagagcctctggcctacatctgccacgatacatgtgcaaaaatgctctctgcagcattatttttcattgtaaaatagcagaacaaatttattattcaataattataaaatggtcaaatgtatgtgactatatttggacaatgaaaaatgcagctgttaaaagcagacaatactgatgattcagatgatgttactgatgaaaataataacagatgacaattattgagcatttatggcattcttacaggcattaccttatttaaagttcagaactaccaaggaaaagagtaacttgtggcaggcgtgagaggttccgaggcacaaaaggaagataggcattcaaggaacaccaggatagaagacccagagtaggagaagagagaggaagaggagtccgccagatgggatgctggaaaccgcgggatagctcggtggagagagggcgctcctgctccgcaagcctccctacgacggcaggcctacccggtcctgctcctgccggctctgggcatctggtttctgccgctccatctccagggagatggtggccaggctgtgccgtgtacccatcaacttctctgacagcgccatcttctcagactccttcagagacaaggcctgggcagaggcaggggacaaagggcttgggggatgggctggtcctgggggcatgctcaggcttcttgctgcctaggaaatgtgcccactgggggcttagaggcctgagtgtgccactgcaggtggacccagggcagacatgcagccctggaaaagggcacaacggcagtcacaagaatcccggacgtggataccactcatagagctcactaacccgccacagcaccctgactgcagagtctttctttctacccatcttacagatgaggaaactgaggctcaaggaggtaaagtgactcgcccaggtacacagctggtgaggagaggagatgggcacagtctgccctgtctccgttacattataggaaagttagggatttgttatttggggggacacgtcagctgatgcctgtgggcatcgtggggactgctcagaaggcagccatgaggatccatgcccagcgtggggtgggacgaggcatgggagaatatggaacagctttcctggtgtcacgactgtcactgtcactcagtaagtgctcactgtgtgccaggcatggagcacagcaaagcctcacgaacccccttctaatcctcccctcctgcaggtaaggaaactgaggcccccaagagggcagtggcctgccccagggctcctagctgccaagtggcagagcagggcccggccccagaactggagcagctcagagagcagcagaggccacgccagggctcacgaacctgctgcttctcgctctcggccaggaggaggccctcgtcatgctcctgctgcagggcagcaatctcctcactcagctgttccttctcagccttccgccgggccagcagctcctcctgctcacgctgcagctgactctgcagctgggcccgctcggcctccagctcccgccatgctgcctcctagggggccaggactggacgcgtgtgacacaccaggaggggcccaggcagaccccccaaaacatcagggcagcaagagccatctggcccccataccctcagagatggagggtgaccaggtaaatacaagggactgataagggctatgacggggacacgccagggccgtgaaagtgccaaggagcagcagtgggctggcctgggggtccgaacatgatcccctgcggagagacaagtaactgtcagccaggtaaggagagaaaagaccaccccaggccaagagcacagcccctggaaaggactacaggatgcagggtgcagagggaaacagggcacggtgagtcacagggccagagccccaggcagtggctgggccaggacaggccgtgtgggccatggggattctaaggacagtgaggggagtgggagagaggactcgagccaaggtgacaaggagcaatctgatttttagcttaggggatgttccgacagctgtggaagagggattggggttgggatggaggagagttaggactggctgtgaggaatgaagggggtcaggggttgccagaggagctggagagaagaacacagatttggggacattaatgaggccaagccaggcaatgcaaagggcaagaagagcaagggggaggtcacagttcagatccctggggactggacaggcgggcaggcagagcccacaggcaaatagcagcccacccggggagcccgagggcaggtgcctgcctcagcagttgtccctagcaactctgtgagaagcagacagagctgccacttcttttttttttttttttttagacagagtctcgctctgtcacccaggctggagtgcagtggcgtgattttggctcactgcaacctctgcctcccaggttgaagcgattcttctgccttaccctcccaagtatctgggactacaggcgcgtgccaccatgcccagctaattttttgtgattttaggagagatagggtttcactgtgttagctaggatggtctcgatctcctgacctcgtgatccgcccacctcagcctcccaaagtgctgggattacaggcatgagtcagcacgcccggccaagccaccccttctttaagagcttcaccatagctcatgcctggaatcccagcactttcggaaagagctttaccgccccctgatggagaagcgtgataaccaccacccaaggccatggggactgcagggtgagtggcatgccctggagccatgtagtcatagcctgcacctctgtcagaggaagccctgtctaggatttggtggctgagggcccctgttctgagggccactctggagagcatgccagtgccagcaatcataactcatggagcatttgctaagtaccagtcactatgttaagccctctatgcagatggtctcagctcatcctcaataccttccactatcctatccctatttctacaggtggggaaatgaaggcacagacaccttgggtagcatcaccagtaagcgaccaagattagattcaaacccaggcaatataaccccagagtcagtgttctagtaacttccctggccccttgcctttctacatgctcaggtctgcgtggcccttcatatggaaacttcttagcaaatgaaagtgctttcctgctgtgcattaggtcaacatttcccaaatgtggttgtggaccctctgcatcaggattaccagggctggaccagatttgggacctgggtatctgaatgtctaataaggaccacaacctccccaccacccctccagtcctcccagctgtccccagggcctccacaacagagagggagtcccatttcacagatgtacagaccgaggcagagcaagaacgatgatgaaacactggctcagacttctgcccacccctccccagctgcctgaaccttttcacgctggagtcactgtaagtcctcctcctgggctgcccactgctcccgcagagaggcctgggcctcccgctcagcctgcaccagcttctgggccatcagctccttgtctagactggctttctcctgcgtagctattatttgctgccgcaggcccgccaactcccctgcacgagaggaatgggggaaagggcagggttgggttgaaatttttccttgggccagcagacttaggccagttgagccatatgggcaaaatcccagaggcagagggcctgcctggcatccagtttgggtcctcttgaagaagtggcttgtcctctctgggcctcagtttccctatctgctacatgggcccactggccctgacccctttcctgcctacctagaatggcattaaaggcataaaatgactgatgagaaggcctcccaaatgggacggatgtcaaacatataacaaccctaggccaggtgccatggctcactcctgtaatcccagcactttgggaagctggggcaggtggatcaccttaggtaaggagttcaagaccagcctggccaacacggtgaaaccctgtctctactaaaaatacaacaattagctgggcatggtggcggacgtatgtagtcctagctacttgggaggctgaggcaggagaatcgcttgaacccaagaggcagaagttgcagtgagctcagatcgcaccactgcactccaacctgggcgacaagagtgagactctgtctcaaaaaatcaaacaggctgggcgcggtggctcatgcctgtaatcccagcactttgggaggccgaagtgggcagatcacctgaggtcgagagttcgagaccagcttgaccaacatggtgaaaccccgtctctactaaaaatacaaaattagccaggcatggtggcgcgtgcctgtaatcccagctacttggaaggctgaggcaggagaatcgcttgaacctgggaggcggaggttgaggtgagccaaaatcgcgccattgcactccagcctgggcaacaagagtgaaactccatctcaaaacaaacaaacaaaaacaaacaaacaaacaaaaaccctattactgactcagcacttactatgcgtcaagcacccagctaagtattttagacataacctcattttgtcttcataacatgcctatgtagtttatcctcatccccgtttaacagatgatgaaatggaggatcagaggagatcagcagcaacttcccacagctgcacagctacacataaagcatctcctttaatgactgacatgaacatacctgtcaagcattaactatcagcattaatggaaacgactacagggaatggaaatggtatagccatcatctaaaaaccatctcccgggttggaaacccaccagcatttcccttcctggttctgtctggctcaggtgtacatggacaggaaaattaatttccatgacccaagtaggtgcttagttaatgttagatgagcagaaagaagccctgagttcagagattcgatggggaacggtgcagggaagtggggctcggattctggggccaagagagtcatctgaaaaccacagagaactcagactaacaggcctgatgaccgatgaacagcagttactgttgactcagccaggcaccgtgccacggccttacacgcttttcccatgtcatcctggcaacaggcttagaaggtgggcattgccacctccaatcatcagctgaggaatctgcagcccagagaggaaaggggcttgctcaagggaaggtgagatctaagtggtggcacaggactggaacccaggccagccagactcctactccagtgctcccaacttctgtgagactacagacattgggaggttgcagtctgggctggaacctggtgttccccccaagtccccagccactcgtaccagtcagggtctccttggccagcagcagggcctgcccctcggcttccagctgctcccggcgggcctcaagctgggccagctgccattgcacctcaaacaggctgccctccagggcttccttctccaagctgcagcacatacagtgcgtgaggccctgggactcagcctccctggccccaggaaactgtggatctcagggagtggccaggcatgggccaagtgccaatctacctgcctggccaggcccacactccctggggaagcctgagcccacagctaggacgagttggcaagccagactccttagtaactgcccctgggggcccgtgcctgggtgaggctgttcatggcgtggccccaggaggaccgcccagggcgggttgggcagagcccaaggccttactgcaggtgtgtggcctcctctgacacggtcctgccttcacgctccgcaggccgccagctgcacagccaggccagcgtgctccttggctagcgcctccttctcccgggccacttgccccagcgtctccacctgtcactgggcctcccaccgggcctgctccagctcctgctcccgcctgctcagctgccaggagagctggctcccacccagagactgagtagcactcccagcatcccccagcttgttcatcgtgcagtaccccaactctgggcctaacccagtcctggcagaaggcctgggttcgagcccagggtctgccctgatgtgctatatgtacttgggcaagtcatgaccttctctagatctgcaatgcacgtgtgtacaaaaaccagggcccggccggacacggtggctcacgcctataatcccagcactttggcaggtggatcacttgaggtcaagagttcaagaccagcctggccaacgtggtgaaaccctgtctctactaaaaatacaaaaattagccgggcatggtggtgcacgcctgtagtccctgctacttgggacgctgaggcaggcgaacagcttaaaccccggaggcagaggttgcagtgagcccagatcgtgccactgcactccagcctgggcaacagagcaagactgtcaaaaaaaaaaaaaaaaaaaaaaaaaaagaaaagaaaaatgagggtcctcactcagctttggaagtaacagaacccttgtattactctaagcagagaagctgaatatataaaccagacccaaatgcagctgctcagcaggcctcaaggtggagacttgcaccctgcttcctgcactccctaccccatcctctagaggcacctcccagaaacccaggccctccaggatggaccttgcatgaaggtccctggatccctgaaacattaaggtctcttcgagatgtgaagttcccaaaagtctaagattccaattctaaaaagtctccacctattattaatctgtatcattattattattattattgagacggagtcttgctctgttgcccaggctgcagtgcagtggcacgatcttggctcactgcaacctctgcctcctgggttcaagcgattctcctgcctcagcctcctgagtagctgggactacaggcgcgtgccaccacacccagctaattttttgtagagatagggtttcaccgtgttagccaggatggtcttgatctccggacctcaggtgatccacccgcctcggcttccccaactgctgggattataggcgtgagccactgcacccggctagccccatgttataaatggggcaactgaggtatgggaggttgggcagcttgtccaaggtccccagctaggagaagtgggactggatttaacccagaagcaggctccagtgcctgtgacttaacccaggactggatgcaggaggctgcgagcctggcctgccccacatgctctccagaccaccccacacacagtttggcctacctgtgctagctgctcctgcagccaactgagctcatggtgcagtgtggggagctgttgctccagcgcctcctgggcctgctccgccactcatagggagccctccaggccctgccgtgccacctcctgctccaaccacagctcctccagccactcctgctctgccggcgccactgtggcctcctgctccgcctgccgctgccggccctgcagcatggccttttcttcctccagctgtgggccggaaaggagtggggcctcatgagcagggcgtccctcccaggaccaggacgcctcctccacccacccaccagccacgatagcccaggggaggctcccagggaatgagggacagtgcccttgggtgtgtgggacactggggagggggagatgaggagggcccatggagcgtcggtgctttgactcctagagaggacagacagacagacggagatagacagagaaccagagacagaaagggaggcaggggccaagacaggtgcagggccgggcccagggtgcctcactgagtggggaggacgggtgggcaaggtaggtgggcccgcaggtgcacagtgtacctgggtgacaaggcagttcagatccaacttgtcctgagcaaggctctcgttgagggcgctcagcttggacagggagtcctgcagggaggcctcctctgccctcagcttggtcacggagagctcgagctccatgcggccagcctcaccctgcagggtcaggccccaagagatgaggaagggcagaaaggtcgggaggaggtgaggagagacaagaagagacccagagagatggaccctcggagacaggggaggggagacaaggaggggatacggcgtgagatggaaaaaaaaatcaccgcagaaagcctgctgcttatggagccatttaaaagccatgcaccgcaaagctgtgcaaaaatagctcaagctgcagggcagggccagagttcagaggatcccctgagtaaggtctagggatagcactgctcagagcccaggctgcagcggacagcgcaggcccccccgccaaggaccctctgcgctgtggccacaactctcagactccaggagctgaatctcaggatgaccctgagctataggcactgcccccaggagcatccagaacagcagggatacggccataaagagaggtcagtccacttatggctgggaccagaggtccagaggtctgtggcctgtgacaaagatcagcctgtatccagaaggaaggggtcagtctgtgaccaggctcagaggtctgcctgacactgggaccagtctgtgccagagtgacaaggcttggggctgggggtcagaggtaggtttgtggttgtgcagcagacagggacccaccttggtcagcgcctcggccacctcggtcttctcggcctgcagcatgtcccgttgcagcgtggcgcggctcagcgcctccctcacctccaccagctccttggccaggactgagcgcttcccttccagctgctctagttgtctatggctgtgggacaaagggtgggtgggtggcccatgtcactttcctgcccgaacctcctgtagccagcaagatgctgggccggggaccaggcctgaggcacgagtttggagagaaacagcctgagccacagggcaaccaagcccactaccgcttagctccatgaccctgggcctccgttttcacatctgcaaaatgaggtaacacttgcctcgtgacattgtttgtttttttgagacagagtcttgctctgtcgcccagtctggagtacagtggtgcgatcctggctgactgcaacctctgcctcccaggttcaagcaattctcctgcctcagcctccctagtagctgggattacaggtgctcaccaccacacctgactaatttttgtagttttagtagagacggggtttccccatgttggtcaggctggtcttgaactcctgacctcaggcgattcgcctgcctcggcctcccaaagtgctgggattacaggcgtgagccaccgtgcccagcctgttttaaggatacaaacttcacatgtgcttaaaatagtgcctgacacatctccccaaggaccttcagaaacaagaataacatgctccaccacagtctactaaacatcatcagcgatcacgtccctgagaggtaagcagcgcagtggtgaagaggttaactctgaaggcagaatgtctgggttcaaatcctggctcttctgctaactgtgtgacctggggcaagtgacatggcttctctgtgcctcagtttaccatccacaaaatggagataacagcttctatgtcacagagttatcatggagttaaatgagagaactgaattgcttaaaatggtatctggcacttagtgaaattagtaaggatattattattcttctaactaaatttttaaaatactactactaatattactagtgttattttaattattcttgttattatcatccaagttctaccttttaactagttctctgactccaggtaagtgactatacctccctgagccccagtttcctgaaatgggtctggttagaaaacccgacatcagaggggtccagacggtaggaggcccaggacccagtgggtgtcacctaaccccatgggggcactgtcaggggacccgaggcacatttgaagggtcctggcagggaggtgagatgctgctaacctgcgctcaagctcccggcgaacccgtgcgccattctgcaccgcctcttcctgctcttcctccagccggtcccgctggcgctgcagctcctcctgggcaacctgcagcttctcccgctcctgcggcagctcctcggcctgctgctgggccacctgcaggctgtggaccaggttgctcttctcccttcaggacaaggggagcgggagcagaggggatgctggggctgctctctccagggaaggtggctggctgctcctctagccatgagctacatcctcccgtcttccaaggcacctgcctccaggaagccttccctgaccctgcccatagcagactcatttcactcacacactccagcagaagaacctggctttccttctccccagcccgcccacttagagtggatggaggtgctggcgtgatctctaagcactctaccacgtagaagaggccaggctaggctcctgggacacacaggcaattgtgccaccagttctgctaggccatgtgaccaggaaatgtcccctagaacaccccatgcccctcaattctgggaagcctgatagagctgagtctgcagatcccacagcttcctgctacacaggcacatggtggccacggcaggggagggaggagaagggaacaactaggaccccaaagacttgctgtgagctgccactttccccactggtggtaggtgcaaaaaacttcaagacgtgatttttttttttttttttttttgagatggagtctcgctctgttgcccaggctggagtgcagtggcacgatctctcctcactgcaagctccgccttctgggttcacgccattctcttgcctcagcctcccgagtatctgggaatacaggcgcccgccaccacgcctggctaatttttttttttttttttgagacggagtctcgctttgtcacgcaggctggagtgcagtggtgccatctcggctcactgcaacctctgcctcccgagttcatgccattctcctgcctcagcctcccgagtagccggaactacaggcactcgccacgatgcccggctaattttttatatttttagtacagatggggtttcaccgtgttagccaggttggtctcaatctcctgacctcgtgatccacccgcctcggcctcccaaagtgttgggattacaggcgtgggccaccgcgtccagcaatttttttgtttttacacacagtctcactcttgcctaggctggagtgcagtgacacaatctcactgcactccacacagcttgctgcaatctccacctccagagttcaagcgattctcctgcctcagcctcccgagtagctgggattacaagcgcctatcaccacgcccagctaatttttgcatttttatttagaagtggggtttcaccatgttggccaggctggtctcaaattcctgacctcaagtgatctgcacgcctcggcctcccaaagtgctgggattacaggcgttagccactgtgcctgggcaattttttaaatttttagtagagatggggtttcgccatgttggccagtgcctgcgggacaagaccgacggcgccacgcaggtgttcctctagggcccgccgctcactctcgctgtcgctaagctgcttccgcagggtgcccagcaggtcctggcttgcctcatagcgcccacgcatgttctggggcgtggggatcacagagtctagcgggggtcctttgaggcctccagagcccacctactctcttctggttccagggatacacactagcctacgctaggcggggtccagggcctggacctgccctggggcaggataggggcctaggcctgagagccaggcttccactcccctcctatgtgccctcaccaccctctgaaccctcatctccctggggtcccggacaactcctatcaaagcccccgggatgccagacaaactcccaggcacactcgtctcctgggttctgatcccacccccagggctcccaggctcctcccccttgcatcctggttccactctcacactcctccctaccctggctctgcccctagttcccaagctctcatcctaggctgtgatttcccttgctagaccttttcccagggtcctggctctgtatgaccagggacctgtctccctctctaccaggaccctaacactgtcgcagcctcctccctccaccggctgcccaagcacccacccccagctgcccaagcacccccacttctgggctggcttcagcgcagagccctcgaccacctccttgggggtcctgacaccctcagacactatttctcagggctctggctgcaccccagggcgctcagactcctcccccagacacgcccccacccccacctggagggcgcgagcccctccccctgggcctctggctgcgcccagaaaactcaagccccttcctacctggaccttcagctggcaaaagtgcagggcggagagaatcagggcaagcgagcgtggagtcttctgagcaggccggggaggggcctctgcggggcgaacggcctcggcccggcgaggagcgccgcggtggagacggggtccgctggcccgagagcccccgcaggctgcggtcggacgctgttggacgcaggctgccgctctcagcgtcagacaggacggcctgagggtaagggagggaagcaggaggccgcagagttaggaacttcggggttagctggcaaaaacgaccaggggaggctgggggccgcctcatcccaaatgctcccgcttacaagaagccttctgatttcacctcctccactagctcagtcctcagctcgccgctgaggcatcccatttattgcgaagacatcatttggcattgctcacaggtgggctccgagagggccgtgcctcccctctgagactgggggctccccagggcagaggccgggtgagctagcaggggtgctgagcagctacagcctgggtcccagggccccacccatctgcagttcaatccgaagccaccgaaaggcgaggcgggggagcccaggaccgcctggcagggccctgtcttcccgcctttctgggctcacacctgtgccaggtcccttaggctccgctgtagcccctctccatcctctgtctccagggccgcctgctcctgtagccgcagggattcctggagtgcggtgagggagacaaagagtggtcggggttctgtcttacctgaaacctcccctttccctccctccctggcccaccactgatcaggtggcctctgaagccatgtccataggccagccacctggtagaccccacagcaggcccgaggccctcaatgaacagaccaggcccagagaagagctgggttctgccccaggtcacacagtcgattgcaggagagctggacctagaacccaggccaggccccacacagaggggtgactaaaccaggctggaccctgggggagtgagtgtcccactggtgggggtggacagttgggattccaaaggcagcatctggacctggagagcgtggatgggagttcaagtcccaactctcctgcttactggctctgagactggacaagcatttcccctcttgggcctcagtttcccatccgtgtcattaggattactctacagggctgctgggagggagaaatgggatggaggaagtgagtgtgcttcccacaaagcctgcacacctgtgtgggctgaacctgagtgtgagtgggatgctgggggtggcccaggcagcccagccctaagcctgtgtccatggatctggccggtaccccatcccaccctgccccatctcaggggcagctgaagctcaccagggcctcaagcttctcggtgaggtccttgtcgacctgatccttctccagattctgcttctgtagacgcttcactgccaggcccagctctgtcactctggagttgggggagcaacagaggtgaatacgggaccaccccagcctctcaaatccactagctctgtgtccaccatgcttctccaaacccgaggcagggaccctaacatccacctccctggctgtgtgaccttaaacaagttgtggctcctctccagacctcacacttctcatctgtgaaatgggaatgaggttcccaccagctttatctcatgggaaagcactggaggacttacccaggtggcaggagtaaggggcacaagttgtttttttgtggttttcttttgagacagagtttcgctgtgtcgtccaggccggaatacagtgatgtgatcttggctcactgcaacctccacatcctgggttcaagcgattctcctgtctcagcctccctcgtagctgggattagaggcacacaccaccacacccgactaagttttgtatttttagtagagacagggtttcgcctattgggcaggctggtcttgagctcctgacctcaggtaatctcccaccttggcctcccaaagtgctgggattacaggtgtgagccacagcacccggccacaagttctgtcataggaggctaagctgtttatgataaacactgggcaactgccttcggaacctcagtggggtgcctgggaaggctggctgagctcacagaggaaggccctgctcctagtgaacagatgctcccttctccccaactctccagttttaccttctgcagtgacgcctgcctcatgcagcacccaccagggaccctcctggcactgaggtcagccttgtccaggtcgctttgcatctgctgctgggacaggtccttctcgtggagcaccttgtcccgcagctgctcctccagctgggcctgcttctccagggctggctcgacccggctctctgccagccgcaggcctgtgctcattcccaggccggcctcctggacagctcccctcccagctgcagcgggtcccttgggaagagaacacaggatggggatgggatggggctcactcccaactacaaattaaaactagtctggggctgggtatggcggcccacacctataatcccagcactttgggaggccgaggcgggcagatcacctgaggtcaggagttcgagaccagcctggccaacatggtgaaaccccatctctaccaaaaatacaaaaaattagccaggtgtggtggtgcactcctgtattcccagctacttgggaggctgaggcaggagaattgcttgaacctaggaggaggaggttgcagtaagctgagatcatgccactgcactccagtctgggcgacacagccagactgcgtctcaaaaaaataaataaataaaaaataaataaaactacactgggctgggtgcggtggcatgcacctgcagtcccagctatgcgggaagctgaggcaggattgcttgagcccaggaatttgaggccagcatgggaaacatagtgagactccatctcaaaaactaaagaggaagaagaaaaaaacaacaaccctacactgggatgccatttgtccactatcagattgggaaaaaaaaaaagggacacataatacacaaagagaggctctggggcaacaggccttcccctacacagctggtgggagggtgagtacaatcacaatggagggcactgagggagatcttcgaaaactatgcaggcataggaccttccccaccggctcctcctctaagaatggatcctacagatataccccagcacagaggagatggcttgtggacaaggaggttcactgcagcattgctcatgtaagatatcctggtgacaacctaaatgtctatcaaaaggggactgctactaagtacatgatggtacatcctttaagtggagaactgtggccaagaaaaaccagtggagaagttcttcctggcctgatccagagccacctcccagttataactagtaggtgaaaaaagcatcttcaagaactgtgaagatgaaattttaccaggcgtatatacaaaaaagtgtgtgtgtgtgtgtgtgtgtgtgtgtgtgtgtgtgcgcgtgtgtgatctcatttgctcatataaaataaccctggaaggtcacttaagaaactgataggccaggcacggtggctcatgcctgtaatcccagcactgtgggagaccgaggcgggagggtcacctgaggtcaggagttcaagaccagcctggccaatatggcgaaatcccgcctctattaaaaatacaaaaattagccaggtgtggtggctcattcctgtaatcccagctacttgggaggcggaggtgggagaatcacttgaacccgggaggcagaggttgcagtgagccaagatcgtgccactgcactccagcctggagactcgcagcacagcgagactccatctcaaaaaaaaaaaaaagaaaaaagaaaaagaaactgacaatgcttcttacggtaacttggtggccaaaaaaaaaaaaaaagaaagaaaataattgtatatataaaaagaaaaagaagctgatgatgctgcttgcctccaaggaaggaatgggaatatctggggtcagaggtgggagggagccattttactgtgtacccttttgaaatgtgaataggtgacttcatcaaaagtaaaatataaaaatttgaaaggctacttacaaaatttttttttctttttgtttctttttcagatggagtctcgctctgttgcccaggctggagtgcactggtttgacctcggctcactgcaacgtccgcctctccggttcaagcgattctcctgcctcagcctcccgagtaactggaattacagatgtacgtcacaacacccagctaatttttgtatttttagaagagacggggattcaccatgctggccaggttggtcttgaactcctgacctcaggtgatccacccgcctcagcctcccaaagtgctgggattacaggcatgagccatgacgcctggccttaaaatacattaaaaattatttgtattttaaaaaattaaaatgtattttaaggccaggcgtggtggcccatttcttgagacatagcaagaccctgtctcaaaaaaaaaaaaaaaaattagctgggtatagtggtgaacacttatagtcccagctatttgggaggctgaggtgggaggatcacttgagcctgggaggtcaagcctaacatgagttgtgattgtgccactgcactccagcctgggcgacagagagagactggctcaaaaaaaaagtattttaagtccataatacaggttaaatcctttcctttcctttcctgaatgacctgtaccactggttatccaatagtaaggagggaaagtgcctcattatagaattctaattaatatacacaggagtgactaaatgagaagctcacagttttgcagcctctaatgagtgggttggatcttgaaaagagagacagctggcatagggacatcctgatggaagaacacattctacttatggagtcttgatcaaacgaaaaagcaagcagaagagcctgaatctgacctagctttacatccaacatccaatttacaggaaatacatgggataaagaaatatgttaattgacaccataaggatgcaaccagcaaaatccagaccatgagaatctccaaggacaactagcccagtttcctgaacaaataagttaaaaaggacttcaaagacaaagcatgggccgggcacggtggctcactcttgtaatcccagcactttgggagaccaaggtaggtggatcacctgaggtcaagaccagcctggccaacatggtgaagctcccatgtctactaaaaatacaaaagttagctgggcgtggtggcgcactcctgtaatcccagctactcaagaggctgaagccatagaattgctgaacccaggaggcagaggttgtagtgagccaagatcctgccactgcactccagcctgggcaacaaagcgagactccatctcaaacaaacaaacaaacaaacaaccaaacaaacaaacaaaacaaagcaaccattcgcactttgtgaatgtctatggatccggattcaaacaaattgtaaagaaaaaactaaagcaagactatctgtgactttttatttatttatttattttgagacagagtttcactctgtcacccaggctggagtgcagtggtgtgatctcgactcactgaaacctccgcctcctgggttcaagcgagtctggtgcctcagcctccccagtagctgggattacaggcatgtgtcaccacacctggataatttttgtatttttagtagagatgggggtttcaccatgttggccaggctggtcccgaactccagacctcagatgatctgcccgccttggcctcccgaagtattgggattataggtgtgagccactgcacctggcctatctgtggcatttatgagacatatggaaaatttagacgctggctatttgatgatattaagaaaagattattaaaccaggtgcagtttctcatgcctgtaatcccagcaccttgggaggccaaggcaggaggatcactggggcacaggaattctagacccgtctgggcaacaaagtgagaactcgactctacgagaaataaaaaaatcagcaagcctggtggcatggacccgtggtcccaactgcacaggacctgaggtaggaggattgcttcagaccaggaggccaaggctgcagtgagccataaagaaaagaaaagattactaactaaaagtaagtccttgatatcagccagatgacactaaatcccatccattcccctgagctcacaggggggctgcctagactccagaaaaaaggctgtgcctagtcctagactctggcatgcaggaggtcagaaggctgaattctccactaaactcaaaagtataaccagtccagactgggtgtggtggcccgtgcctgtaatcccagcactttgggaggccgaggcgggcagatcacctgaggtcaggagttcgggacgagcctggccacatggtgaaaccccatccctactaaaaacacaaaaattagctgggcgtggtggcacattcgtataatccccgctactcgggaggcagaggcaggagaatcgcttgaaccttggtggggcagaggttgtagtaagccgagatcgtgtcattgtacttcagcccgggcaacaagagtaagactctgtctcaaaaaaaaaaaaaaaaaaaaagtatgtggccgggtgcggtggctcacgcctgtaatcccagcactttgggaggctgaggcgggcagatcatgaggtcagtagttcaagaccagcctggccaacatggtgaaattgcgactctactaaaaatacaaaaagtagctgggcgtggtggcatgtgcctgtaataccagctacttgggaggcggaggcaggagaattgcttgaacctgggaggcggaggttgcagtgagccatgatcgcaccactgcactctagtctgggtgacagagcaagactccgtctcaaaaaaaaaaaaaaaaaaaaaaagtagccctctctaagtcttaattccttcatctgtaaaaacagaataatgacttatgttagagatgctgtgaagagcccagggaataacaagtgctgtctgcataccacataacctgtccgctctcaaaggtggctgggctgatgatgtctggaagaagaaggctgggagaaatgctggttcccaaagtggtcagtaccaaggccacctagtccaacccttgcccctaggcctgtggttcctttggggcagattccagtctcgccaccacccagccaggggagtctgtgttgaatgggccatgtcctggaagtatgaaaggctcagccctctgagctgctggatggctctgtcctgtacccgccagtccataaatggtcagcagagcacatggcccacctacccgagccaaaggagttgggaaaaatctgtctgggtggccccctcatcctctcaacacacaggcctagagggaaaagggtactgtctaatgccagtcagtgctgtcctgagctcagctgctaagaatagcagggagtgaggtggtggtaaccagcaggactcaggcagaacagaggcccattacacacctggctgcccacaggctgccaccacctgctcttccacctttcatgccagttcctaccctactcatccacacagacagaaagctctggaaggggacgaaggtggcacaaagcaccctgacaaagtagccactacccaggctcagggatcacatattcccccagtgtaagccactcccagccctgagctgtaggagcagagatgcacaaaggcccctccccactgctgctctgtcccaggccaaggccaggtggtggctatgcagtcggggtgctcagctagtagcatagaaggctaaagccaaccccatctctgaataccccagtggaccaaggataaaggagcctttctcaaaagcagttacaggccaagcatggtggctcacacctgtagtctcagcactttgggaggctgaggtgggagaatcacttgagcccaggggtttgagaccagcctgggtgccacagtaagaccctgcctcttaaaaaaaaaaaaaaatttagctgggtgctgtggcatgtgcttgtggtcccagctatgtgggaggctgaggtgggaggattccttgagcctggaactttgaggttgcagtgagctatgactgggacatagcgagaccctgcctcaaaagaaaacagttcttaacaagcccacacttggagtggctactcttgtacctgacccccaaagtcgtgtgcctgatcctgagagcagactgcacatatctgtgggcagtcggcctgagacagccaccactgagtgcctacagcacggcccatttggccaagaccagcaacttccctgacctttttggatctcctaggtcccagttcagggccctgaatccccacaaccactgactgacggccctaccacctgctgtctctcctggcggccacagcagcagcagcagcagcaggaccatctctggtatcacatgaggtagggatcagatggctctgagaacaggccaggactgagtatggggtgggggtgggcaggaactctctgcaagcaggcactttctgaccaccacaattgcttaaatagaacaggtaatgatgctgccttttggacctgcctaaagagcagaagtcgtaaaagacagaacagctaaggctgataagggggtgagagacagggacaaccgtgcctcactgcagggacggagaacctacttgatcctttgaagaagtaatctggcaacagtcttaaaagtgactgcagttcaaacactctagccacacgactccagccctgggcatcctcacagcattgtttacaaaggcaaaagtccttccaaactagggcacttgtatgggccacagcagaccccctggccctaaagatgctcagtaagatacattgataatgtggaaaaatactcacgggataacatttgataataaaaataggatgcaaacttctggaagtgagggacatgtccattaccttgatggtactgatggtttcacgggttttatctatatgttaacacttatcaaattgtacactttaagtgtgtgtagtttattgtatattaatcatagctcaataaaaatgttttaagaaaagaactgaaggtgacaaatttttttaaagttttctatacagcataatctgaactacatacattataagataaacagacatgaagttaaaaagcttctgcatagcaaagtaaacgatcaacaaagtgaagagacagcccacaaatgggagaaaatatttgtaaactacccatctgacaagggattaataaccagaatatataaagaacgcaaacaactatataggaaaaatactaatagttccatcaaaagatgggcaaaagatacgaacagacatttctcaaaagaagacatacaaatagcaaacaggcatatggaaaggtattcaacgtcactggtcatcagagaaatgcaaatcaaaactacaatgagatatcatctcaccccagttaaaatggcttttatccaaaagacaggcaacaacaaatgctggcgaggttgtggaacccctgtacgctgttagtggaaatgtaaattataatagtgcaatcactatcgagaacagtttggaggttcctgaaaaaactaaaaattgatcaggtgtggtggctcatgcctgtaatctcagcactttgggacgtcgaggtgggaggatgacctgaggctaggagttcgagaccagcctggccaacacagcgaaaccccatctgtactaaaaataccaaaattaactgggcgtggtggtgtgtgcctataatcccagctacacgggaggctgaggcaggagaattgctagaactcgggaggcagaggttgcagtgagccaagatcatgccactgcactccagcctgggcaacaagagcaaaactccttctcaaaaaaaaaaaaaaaaaaaaaaaaaaaaggccaggcacactggctcacgcctgtaatcccagcactttgggaggccgaggcgggtggatcacgagctcaggagatcaagaccatccttgctaacacggtgaaaccccgtctctactaaaaagacaaaaaattagctggacctggtggcgggcgcctgtagtcccagctacttgggaggctgaggcccaagaattgcgtgaacctgggaggcggagcttgcagtgagctgagattgcgcccctgcgctccagcctgtgcaacagagcaagactctgtctcaaaaaaaaaaaaattttttcaaaaagaaaaaactaaactaaaaattgagctaccatatgatccagcaatcccactgctgggtatatacctgaaagaagggaaatcagtatatcgaagagatatatacctcaaagaagggaaatcagtatatcgaagagatatctgcattcccatgtttgttgcagcactgttcacaatagccaagatttggaagcaatctaagtgtccatcaacagatgaataaataaagaaaacacggtacagatacacaacagagtactattcagccataaaaaagaatgagatcctgtaatttgcaacaacatggatggaactggaggtcattatgttaagtgaaatgagccaggcagaaaaagacaaacactgcatgttatcacttatttgtgagagctaaaaattaaaacaattgaactcatagaggcaaagtactggatggttaccacaggcttggaacggtagtgtagggcttgtggggagatggggatggctaatgcgtacaaaaaaatcgaattaataagacctgtctggtagcagaacagagtgactgtagtaaataataattgtacatttaaaaataactaaaagagtataactagattgtttataacacaaaagataaatgcttgaggggatggataccccatttaccatgatgtgattattacgcattgcatgcctgtgtcaaagtatctcatataccctataaatacatatacctgctacatacccacaaaaattaaaaattaaaaatgtaacacaaagaaagaaaacagaaaagaatcgcatttgaatagtcatgttaaaataacaagatagcaggtgcttttccttctttttttagagacagggtcttgctctgtcacccaggctagagtgcagtggcatgcagaggccagctcactgcagcctcaacctcctaggctcaagtgatcctcccacatcagcctccctaacagctgggactacaggtgcacaccaccatgcccaggtaatttctgtattttattgtagagatggggtctggccatgttgctcaggctggtcttgaactcctggactcaagcaatctacccaccttggcctcccaaagtgctgcgattacaggtgtgaaccactgtgcctggccctctaagtttctgctaaaatgtacttgtaacttttacactgactacactcaaaagtattaaacttgtaaagaaaaggccctggaggagtttgttctttacaaggtcagtcagaagctacaaggggccaggctggggccaaggtgagggcaggtacatgcaggggcagatgctgggtgtggagtaggtgccaggtgctagctgggcatgaatgtgcacccgctccctgacctctgctccctgactctcacaaggaactagcactgcctggagacaggaagaagcagcgtacggaaggcagactctctggccagagatctcgcagccaggagcacagtgagaacagagcctaagcctatctgtccagagcccaggctccctttccctacaactgcagcctccttattctgctctggcccagcagagtgaggaggggccgcccacccagccatacctgccggtggctgctgggggtgcatggtcagaagaggaaagatgcggttcaggtagtcattcagcagcttctcctgcacaatgcctgagccacaagtcagaagggagaaaagggccacacgatgagtgcagctcctggcccctgctggccccagagacttctggtcctaggccagccacaggtgcagcaaggcctgaggcctttgtcccttccttctcctcccaacaagaggagcctccttccttctctgccagcccttacctgtgaccctggatttctcagcatctgaggtcagcctacagctcttgcgggagaaagacacgccggcccccttggatgccatccttcgtctctcatgggcagccagtggtcctggaggctgaggcagacacagagcctgtctactcagggccagccaggggcccccacacctgacctcagtcctgccatggcaggaagtcttgggagcaggtgaggccaggggcatgcacactaacacataggacaggggaatgcaggggctcccagcttcctacacaggcagggtagccagggtctaggcccatgtaacagggaccacttcttgttctccagtgtccctgtgcccagcacagggctgggcagagagcaggtaccagatatatttttgccaaaccataacaaaatgtctcagctctgtggaaatcagaccaaaatgtccaaagtgaggtgtcctaggggcagagcccctgtattcatctcggttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcactgttcccactcacacatgtggcctcccacctcatccaagcaccacccttgcccagccctcatggcaaactccattggtcctcctagtgcatctatccctcacatcatgttgctgctgcagctgctccaaaacctgcactgagtccctggtgctggcctcactgatgtgtagctgtgctgtccaacacagcagccgtcatccacgtgaggttacttaaatttaaagttttaaaaattaacaattcgatttctcagttgcctcagccacatttcaagagttcaatgaccacatgtggctaacggttactctattggacagcacaaaggtagaacattcccaccatcatataaagttctattagacagcgcaggtctagagtttcgctctgcagcactgccttagccagcactccctactctgccgttcagtctcttatctcgccccaaacagaccctctactcccgccacaaacccctgtgggtctgcaccacgcctgctcctcgggaaggtgattttcccgacctcgggccctcggtgggcctccatgatcggtgccccttcactaccacagtagttgaagatctgattaaatgcagtcattcatttgatgagcagaccttccagacacccactccgggtgtcagttgctgaggacccaggtgagaggcggaccttgtccccgcccggggactccctgtcacggctatcccgtccaacctcgccggggtatccgggctcagaactgaacctactccgtctgggagcccaaggatggctcccccaagtcgcccccgcctggccccaagctccagaggacctgccagaccagcttccgctcggagtttcgcactcagatcccggcgctgcaggtgccctcgcagtggactaaactggaccgcgaagggaatagccggaacccgccaggctcagagccctgccgcccctcactcaccccgagcctcggccgccgcgacccggttcacaacatccgcccaacctctcggctacggcgtccgttcagggccaaatcacgcgcacgctcgcgcgctgagcctccagccgcgcacgcgcaccggcccgcgcccagcctccgctaggggaccccctccgtggcttcccaccgggttgttccaggcctcagcttcgccgaaaggcctcaccacctccgacctccgcctgccccggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcttcgctcaccttccctgggatgacacttctggcggctgagatgagcgagcctctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatggctcctgtcaccaggtctcaggtcagggtccagcaggccctgagctgacgtgcggagccagagccacccaatcccgtagggacaggtttcacaacttcccggatggggctgtggtgggtcacagtgcagcctccagccagaaggatggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcaccagtgggacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgccgggtgggtaagcggcgccgggtcaagctgggagagtggagggacaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtcccagggtcttcttcacgccccattaccgcccccaggttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgggtccgctgagacgccgcacaagccgcagtgaatccctggtgctcccggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccgcagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatgatatgtggtgcctccagggaccaagtgtgagattgcaggccggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccagggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgcttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccccaagaaataaattatttgtcctctggagcttgtcacagggggatttttaaaaaaacattaaacagaaagacaactgtgcatcttagaaagataaaaggccaattcttcctctccggctgataggttcttaataatagtgatatctactaataagatgttttacatagtgtaaagcatgttcacatacaaattacttagcctctttgagcctcagttttcttatatgtaaagctggattaatagtacattttgtgtttaaaaagatgatgtatatgaagtgtttaccatttttcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggctctcagaaaatattctcagctattctgttagcttgatctcctaccatctgagagtgggcttccttcaaacaaccaaatttccaggtatttctaaactgcccttcccctacaccattctttgattcagtatttcaagacccctaagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacgcaggattttctataaccctctttctgctttgagctcctaaaggtatttcatagaaaaatgaccttatttttaaatagagggggcagttgaaaatcagtgaacggacctaccccctaatgatttttttctcagacataattataataattagcattataaagtgctaattatctttggacacagaggacctgcacaccagagacagaggtccgcattaagtaaagtgaatttcactttcttcagttgtgagatttctcttttttcttctttgtaatgatgcaaagatatatcatccaccaagcctcatttaaaagctttttccagttaaggaaactatctcttggccatccacagccagactccatattgagattatggatattcaaagaaattgtctttcccttgtatattgtcataactttttgtgaaatgttcgttttatagttccaggccagcacctagaaccttgctagaataaaaaactgcagaaatcatgagtttctagtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgtaaaaaaattagacgaggaatggggcattggtgtaagattatacagagtgtaaagttgggctttctcttatcatctgttgtcaacaacaggatgattgttactgttacccactccttaccatcattcacacagagacattggatattgaggagagactttaaaacagaatattagtaatgcagagctataaagagccacgatcatattaatacaatcctccatacacatagtgacctgtctgcagctccagcctagagaaacccagttattcatttgtagtgggcagccccattatcagaaagcgctattcaattggaagtgctcatctgtgttaggtcaaaaacgacttcctctaaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatcattaaataagagtgtaattagtgatataaagcaagatgactaaaaagaatctctcattattatgtttgcacagcctgtatagaaattatttgaactagaaaggatttgctaagtaaattatttctatttccctcacttaatagtgaatattatggtgattaggggaaaaaataagctttcttttttcttttgagatggagtctcactctgtcacccaggctggagtgcagtggcgcgatgtcggctcactctgtcacccaggctggagtgcagtggcgccatctcggatcactaagccatctcggcctccccagctcaagtgattctactgcctcagactcccaagtagctggaattacaggtgtccgccaccatgcccagctaatttttgtatttttagtagagatcaccatgttggccaggctggtctcgaactcccgacctcaagtgatccgcctgtcttggcctcccaatgtgctgcgattacaggcatgagccaccacgcccagctaaaagaagcttttctgatagtaactttgttttcccattctggagtttatggcagtatgaaaaagactgaatttataagcagaagatctgtttttgaaatccggggacctgtatttcacaatggctttgatgtgttttgattgtgcacctttagacaacttatcagtttcctcatttttatacagcaataaaatagtaacagctacccattaaattctgtacagaagctagggacagacgcaataacacttgcatatctataaaggctttgtaaatgtgggtattatatctaatgtttatgcacatgctgtttgattattttcatttggaattccactccattaaaggaaaagtaacatacgaattcagattcttgtaagtcttcaggcatgaggcctccattgactaagtacattgcctacataatttctcctaacccaaatgaatctccagttaaaccaagctggtggttatgtactgtctccagaggatgccaagcataaagtccttgagtatattcatcttggatcctctgattggacaactgcggtattgagacttcaagttcccccttgaaggccccagacggtacctgtaattttactcaagttttaaatgtatgctctttgttaagaaagagtgacaatgatttgatttattttccgtgactggggttagggatgggggagactctaggaatgtgacttaccagtgaggttctagttttataaatcataggacaagttttgataggcaaatgttggactatagggctgaggttgttttccaccacaacatatagacttctactagcccttgaaggaaaaaacacgagaaaatcagttgggtcagctgagtattcctttacgagtatggaacagacttacataacaattctgcaggtaatggctctggaaaggtcaaccacttagttttggacaactcttttctattctgtataaccactttttcaccaaaatgatactaaataaatatgctataggaagctatattttgacatgactgttttaggcaaagatacactcaccaacttactccacaagagtttctaatcagagaatatcatatggatctatttgaattgctcccatgcttggctgagcccaaaataatttactgtgcatatgtacaccaagtgagaaggttgaggaggtgtcacttgtacatctctttattcttttttttttgtatgtgtgtgttattttcatgtgttttgaaaggctctcttgcttagcttttattttgccattaaagatttttttctgtgctataactgtatttttaagtctggtttgagttcaagaaatccacaaattcacaaaagattaggaataatttgtgaacaaaatgatgcagaaataaaaaatgcattttccaaataactcccttgcagtccttctcgcccaactaccactttctattaagtttcttcttcctactctatgaagtgccatgagctttcaattcattgtattttaagtataagctatacttactaaccttcacgttattctttgctacttaaataagcttgctttcatagttcaattgacgtattgtttaactgatatttttaattggtatattttgatatatattgataattgatagatacataattcatttgagatattttgggtatggagggttggaaggaatcctttcataatttttctacttaaaagaaatcttttttcatttaacagcttttcccatggggatagagttttcatgaataaagcaaagtcattaaatgaggtatatggtacatcttttaagagtcacagaaagaagcaacaacaatttacccaggcagagggtataagtttagaccttggttgcctgatttgtgggacaagttctttaattttttttctttatattttgacttttttttggactctctcctccccttccaggctccaggtcaaatacttgacacctgaatgatgttcaattatttaaaagatggattggccagctcagctcctgtctcagacagactgtctttaaatgtattttcaacatgtcttcagacagttatttttcctctgttcaattttgttcatcttcttacttaaccgttcaagtgctcctatttcctttttaaatgtagtattgagaagtgcaaacattattggaaaagagagtctcactagcataattgtgcattatcttcctcttatatcgccggcctccctgcacccccatgcccacctcctcctcgcgcctccatgccgcctcccactgctccagctccttgcagctgcgagtccagtcactggtcacctttcgtatctcctcactcagagcctggttggccaaacctgcctggtccagctgttctcagagcatggcattcacctgggccaggctggcactcctgaatggggcacaggggatcagtaggcgctcgcccagggggccatgctgccagccctggccctccctgctgctcctcctccagccagatgagggcactctccaggtcttggctgtgctctgcgtcctgggtggcacagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcgtctccagctcaccagattgcagccacagagcctgctccagctgcagggaagggccctgggtgagagtcctgggcctcctgggaaggcaggctcaggcctctgtagggggtggcaggctgggcccagacccacaatgccttgtaggctgatagcctggcgccctggggagcagcacatgtgggcaagcccaggggcagtgcacgtgtgcatggggtgatgcagccatgcacgggcacgcagatggggcatgcatggacacatgcaggtgagcccacaaacccaaaccatgcaggcaaagctcaaaggtgcacctggggtctacgtcaggggcctcagtacaccatgcgcctctcctccagaacacttagccctgtcgtggtttctgtttattacattgatgcctgtgtcttcccaccatgcccccaccccagtgtgagctcagaaagcctggattttttgttcctcattgtatcttagtgctataatggtgtctgtggaatggcatggctcacgctcagtaaatatttcttgtgatggtgaattaatggcatgagctcatgggaatacattcaaacagaggtgtcaatccgcctatgcatatctgagcttaaaaatatgcacacacataacacatacaggcaacctcaaacatccccagggggacacgaaggactcccctcatatacacagcattaagatttgtaagaggtgcacacagatgttgccctatacggcgcctgcatattaatgcccacttctggctgggtgcagtggctcatgcctgtaatcccagcactttgggaggtcaaggcgggtggatcacttgaagtcaggggttcgagaccagcctggccaacgtgatgaaatcccgtctctactaaaaatcgaaaaattagccgggtgtggtggcatgcacctgtaatcccagttactcaggaggctgaggcaggagaatcacttgaacctgggaggcagaggttgaagtgagccgagatcgcaccactgcactccaccctgggcgacagagcaagactccatcttttatttatttatttatttatgtattcatttatttgtctcatgggctgagcgaggggaccccggctggtggagggacagctgcgccctgcaggccgctgcgtccgggcagaccccggcctcttgtcgtgcccccggcccgcgacaacccgggcaggatgggcagcaggacgcggcggggcatccgcggagcccgtcgggaacgctctcttggcctccggtgccgggcagcggtgggtgcggcacccacagtgcccacagcgcccccagccctgggacgtggctccagcccgcccccaggcaggcggcctccttcgccgggagcacgtcgcctgggcaacatggagaaacttcaactcttaaaaaaacaagacagccaccacaacaacaaaaagaacagatataagccggctgtggtgactcgtgcctctgctactccagaggctgaggtgggaggatcgattcaaccaagatacagtgagactgtctctcagagaaaaagtcaaacaaacaaaaaaagaggctgtgtaagaggtgactctggggacagtggaaaaacactaaggttttcaagtggtgttaaaagccactaggccttggggaccattgagcaatctacaaagcacggaagcctagatccctgagctctgcctgccaagtaccaccacagctaacatgggagacctccccgacagagactgaaatttgcctcccgaggaaacaagtgactacagacatctgtcccaggacagtaaacaagaaagcaaggtctcacaaaaacaaaaacagctgaccacagcatacaatcactgagaccgagcctgcgactataggtgaaaaaaaaaaatgctgtccattattcataccatgaaagaccaggggaaagtgggaacgcagtcccctactactgttgtgggaatcaggagaacagagagaccaatgggtggaacaggaggatttattgactgcactgaggcccagcagatgaaaatccaaaggctgagccccgaacaaagacagggcttaactttatagacacttctgaaagggggtcggctagtttgaatggcgcggcgggaatttgatggcatgaaactcgggggcaggcaagagggcttatagaagcagaacaaaggcagctaatcaaactgtcacaggtcttgcaatgcaagtatagctggtgaccttgcagctgcactgaagggaaatcaagaacttaacaaaacttgaataattagaaatgggaagggggaaagagaaggtagtaaaggcatttgttgttttttcctcttatctttgttggggcttactgtgttgagagagtctccggaactcactcctcgcggctctgacttttcagatcgtgttaccgaggatctactagggctctatctatggcaggtcttggagtcagccaagtacagggaacctgtcttttccttttaacttctgccttattactacaagttgtacagcacaccatgcctggttttcatcagcaatgtttcctgaggttacagaaagatttctaatcctgggaggaaacactcccttgaagcaaaagtgttctcccccaaaaaatgcaaggagctatcttctagatagccaggcagataattctcaggttttgccccacagaatctctatctaaaatacagcagtggtcatgcctagtgaaaagtttgagggaactcgcccagtgttgggtttcttcagagccatatatatagatataaccaaatatcctaaaagacactgcccttcatcattccatgctgttagacatttacaggaccatggatggtgatctcctccagacaaaaataaatgctggtgcagaataggtaagtgtattataatttgaggacatcagcttttgggcattttaaaccatgggtcagacatgttagagcaagaggccaggttgatagcaagagggagtgtttttcttttaatttgtcaatagcaaagtgatgtttgccactgtgatttcagagtgaggtggcaatttgttgttgtttggttttgtgggtttttgtttgtttgtttgtttgtttgtttttgagacaaggtctcactgtcacccaggctggagtgcagtggcatgatcagggtttactcctgccttgacctcatgaattcaagcaaacctccttactaatcctcccgagtagctgggattacaggcacgtgaccccacaccctggggtgtgaactgggatttgatgttttcagttggctctctaatggaataggttcccttactcttgtagaatcagattgtcttcatgattatcattcttgtgtgcattatatttctactaccctgctatttttttttctatttttcttttttctttttatttttttctttgtgagacagagtctcgctctgtctcccaggctgtattgcagtagcaggatctcagctcactgcaacctccacctcctgggttcaagcaattcttttgcttcagcctcctgagtagccacctggctaatttttgtatttttagtggagacagggtttcaccatgttggcaggctggtctcaatctcctgacctcaagtgattcacccgcctcagcctcccaaagtgctgggattacaggcatgaactaccacacctggctctcaaaccattttagttaagcaaagacagatttgtctggctttttagtacaatgctgaattatcctccaatctatatttttaggaaggacctcgggaatggcaacttggagatatttggtgaaaatgtgaacctttcatgttctgcttcagtccctttttgaaaatccttccaatttaccttttgcaaccagttagtggccttcccttcttcaccagcatgtgagttaattgataaagatcagaatatttgggctcaaaggtttcaacagttaagtcaaattttctgccaaagcctacaggatcttggagcctgctttagaaacagaagagtgaaatgtatttaagtttagatcagggaagtcctttataatattcttaattcacgttttggtgaagtggtatacacaacggtaggctcccctcttcctgtgggtttgggttttaccttgaaaggggctgtcagaacagaagtttcagggaagggaccagatccctggggactttccttaggtgatggtgatggaagaagaggcaaggcaggacaggaaggctcaggtaagaaagactatgcaggtgcaggggcaggaggagaaggagcagttggaggtgaaagagacaaagcctcctcaatatttctcaaatcagaaaacatgacagtctacctccttcagcttacttcctcaatggaggcaattttctcagttcttttagaaattttagaaatttagacatttctaggtctcattggaattaagtctcctatttaatttgtctggttcaaaaaccaaatttctctctctctctctgtttttttttttttttttttgagacagggtcacccagactggagtgcagtggtgtgatctcggcttactgcactcaccacttgctgcatgacagccaataagtcgagagttgaggtgtaggggcagggaaggtgactttattccagagagccaccaaactgaacagatggtgaagtaacatcctgaagaaccatcttaaattaatactattttccggctccttgtacattagggaagggaggaagaaggaggcgattgaggtgaagaggtctgacaatgacagacatgggctgcagtgagagcccaaggggatggtgaaaattgttggtcctttgtcaggtcacacttctcttataaatcttcagcataacactgttacttgtgtatacaacctctctatcttctcaggagttagtttggggaagggattattatcatctgtgctttaaagttaaactgtaagctaaatccctcccatagatagcttggcctatgtgcagaaataagaaaaagcagttagcctggaagatgtcaccacacggtaggaagggttaggagcaaaatgcagtcagtcatgctaggcctccttttcattgccatatatttaatgtatttgaacacgtaagtttaattttttatactttatttttatttatttatgatttttttgagacagagtctcactctgttgcccccccaggctggagtgcaatggcgtgatcttggctcactgcgacctctgcctcctgagttcaagcaattctcctgcctcagccttctgagtagctgggattacaggagccccccaccatgcccggctaatttttgtatttttagtagagacagggtttcaccatgttggccaggctggtctcaaactcctgacctcgggctcccaaagtgcttggactacaggcatgagccaccatgcccagcctaaccaagattattaaaccattctaatttgtcaaaagagtcacactgatttttaaaaaataatgtaatgggccaggtgcagtggcctatgcctgtaaccccagcgctttgggaagccatagcaggaggatcatgaggtcaggagttcaagacagcctgaccaacatggtgaaaccccgtgtctactaaaaatacaaaaattagccaagtgtggtggtgtgtgcctgtaatcccagctactcaggaggctgagacaggagaattgcttgaacccgggaagcagtggttgcagtgagccgagattgcaccactgcactctagcttaggcgacagagtgagactacatctcaaaataaataaataaataaataaatataataataatgtaatgaactttttcatgtctttatataaaaaatattacattatttaaattgttcaaaagcatcaaagattcctctctgctatcaacttcatttattttattgtaccaaactaccaggaccattaatttaatctacagctaaatctattattttttcatgttagaaattcaacaagaaaatttttccctaatgaaacctcacatttcaagcataaggagcctgggcgagttggctcacacctgtaatcccagcactttgggaggccgagacaggtgtatcacttgaggtcaggagtttgagactagcctggcaaacatgatgaaaccctgtctctactaaacatataaaaattagctgggcgtggtggcgtgtgcctataatcccagctactctggaggctgaggcagggaaatagcttcaacctgggaggcagagcttgcagtgagctgagatggcaccactgcactctagcctgggctacagagcaagactctgtctcaaaaataaataaatagataaataagcataagtagtaaaaaaataacataaatttaaaaataaggcacagggtcttgctctgttatccaggctagagtgcagtggggcaatcatagctgaccaacttggaacttctgggctcaggcaatcctcctggctcagcttgccttgtatttttttagagatgatgtcatgccctgttccccaggctggtctccaactgctggcctaaagcaatccttccgcctcagcctgttgagttgctgggagtacaggtgcaagacatgcagcctagcattgtagtaaaacaattttcaacaaattcttaattttctttccttttttttttttttttgagttgggagtctcattctgtcactcaggctggagggcagtggcacaatcatagttcactgcagcctgagattacagtcatgcattatcatgcccggccaactttaaaaaattagctaatacttaaaaatttgtagagacaggggtttcactgtgttgcccaggctggtctccaactcttaaagtgctgggactgtagctatgagccaccatacctggcttaattttcttattttaattttatataagtgagtattattgttcctaagataattggggcagtgactcctttacaattttagagatctaatttgtctattcacttcactgaaagagtatgccaatttgtttcatgagaaaatatcctatatttgaaaagaaggaaaattccttccaccaaactagggtgcattctaaagaaacgaattgttctaagtaacatcacttaaagtgcaaacagaggcaatggtatctattaacaatgtttatcagtgaaggaaataaactgaaaatatgaacatcattagatcctcggagggccttcattgctgaaaatctgagtaatattgtgatactcttttgagtctggcaggacattctctttccagggcatgtaacagtgggtgaataatttcttttcattcatttccattaagggctgaacttccttaatgttctggagattattaaatttgatttgtatagttgtgaaaagtactcatattgctgattccattgcttatatgtgatcatataaatcttttctctttctgtagtgtggtttaaacttaatccttaaagggcatgtatttgaatttttcagctggttagaaacctgaatataccaatcaaataaaactgctccttacatgctacagatttagttttcttcctgtactaagatgtcttttagatacagtaaattcgttaaagccaagagcccctaggaaatgaagttgggtgggaggggggacatcgagtagtaagatcactcttgtaacagagatgccactcttgcagatattgacaaaaattgggcctataaaatgtttaccaaacattggaaagacaagatctgaacaacttatcattgctgcagtctcaaatatcaggaaatgccattattctcaggacaataaatagacaataaagaagactcacagaccagattagctgtcatgtatcaccaaacagggactggatccttgttaacacgacccaacagagattgtccccagaaattcacttcataacctcaaaaccaaaaacccacactgatggcaaaaaataatgatgcaaagaatgagagagaaagagagagagagagagagagagagagagagagagagacctgtcctatagccatactcagtgggtaaaagccaaagagctcaatttctgctcatgatacttaatagaacatagggaacatgagccaatagctcaatgggttcagatctgcaccaagtgcctgttggacgcaggattctactgtctccaataatatgtctcagatgcactaattttttttctctttttgagacagagtcttactctgttgcccaggctgcggtgcaatggcgcgatctcggctcacagtaacctccacctcccgggttcaagcgattctcctgcctcagcctcccgagtagttgggattacagacacacaccactgcgcccggcaattattattattatcattattattattattgtgcgtgtgtatgtgtttttagtagagacggagttttgccatgttggtcaggctggtcttgaactcctgacctcagctgatcaaaagtaggtgaggtcagaaaacataccctgggagaggctggcacaatgcccagaaccgctatcgctaggcctggggttttcctctgtagtggaatactagtgttcatgtagtgcagggacaaaaccaattagatagttctgggagttaaaaagagatgatttacagtgccatttgagaaggggtattaaggaatttgccagggcactgatgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctataaagttggctggcagtggatgtaggatgtgggagtgagacatcaaacatgaagcagtcgcttaaagtctaaagaaacactagatatatgaactgcaggagatagtagggaaactggaccggctcctcataaaacttcccgccttctatctccgggaggatcgcagggcatttccgccaagacaggtgagactgcggttctgacctgcgggcctccatgcatatgcgctagggcacctgggggccggcagagccgttcccctacgcaaagtaagagtgttatgtctacaacccaacggggacactgagagccccaaaggccctgctttcttcccagagaacagcgcccatctgcataatttctacctggctctatgaggtgagaacacactccccgctagcacagaaatcctacaaactcctgtgggggctgcgcttggaagcagaggctgtgtaagaggtgacttggggggtagggaaaaacacgaagattttcacacagggtgagaacccaagagactggagaccacggaccaatccctgcaaaaagcagccagggtagaaatggaagagctgagcggacttcacgatagctaatttgtgttacaaagccgatacggctgatgctcgctttttctcctatggcgtgcaggccacatgttacttcttattccccaggcctccactgtaggattaacaactaagacacaaaccaatacgaaaaaagacatgacccttggcgtacggtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagatcttcgggctctgccccgacacagcctcatacgcctcactctttacacacacggtcacttgccccgcgcactcccgagccctttccagccctgacacacagctgggattctcacttccgatccgcggtcctgaacccgctcccagggcacgggaactccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattcgcagactagaatgtttcggattacaaaagaaaccggttctcttcacatccttatccttgtgatgcagcattccgcttgcaattggaagccgtttaatatcagagagaaaccatatttatgaaagtaaagaggctgcttagatgactgcaaaccagccgtccttactggttttatcactggtaatgttataaagacagttgtccagtttcatgaatcttgtaggtttttttttttttgatgttgttttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaatattccaattcttggttaaagaaacccatcaagatgaaaccccagaacccattattctctcttgggtatgcccaagctcccctttcttgagtgtgtactttttgctttgcaataaatctcttctttcactatctgctgactcatctttgactttgttctcacgatggtgtcaagagcctggacaccacggctggggtcgagatcccaccagtgtccagggacctcccccagcccaccagtatcagattctattccattgctcaaatcacaaaacatcgagtggagagttctccttggagatcataaagtaaagattctgtggcatggtggccagttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctgaccagcctttgtggaaagaactggcaccatcctgcagatgtaaccgcctgatgggttcttcctgaccaatgtacacaaaaactcaattcatggagaccatggcactgcaggaaacggtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggcgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatgttttccatatgaaactgttccacttcaggtcatcaggcatcagttacagtctcataaggagtgcgcaatctggatcacgcacatgagctgtatcaccactcagctctcactccagcctcaggtatcagcaagacctcaccaaagattactgtttaattgtctctgtgtgtgtttttgtttgtttcaggtaacaactaatgttggaattatgaaaagctcttctctacttttaacaaagcttagtcacaaacagttccccagttgatgagaaaaactaaaacaacagaacaattgaaagtccgaatctgcaagttcatctctgagaaccgaattttacagccactccagatttgtactccaaatggatagtttgattgtagaaatcacttcccttcagtctgccaatgtgataactgcccaagagaaagtgatgcctacattcgtagataatcccctttcccccatcctatatataactggagtcaacagtagctggaggaaaatggcaagaacttggaatcaagattaggttagaataacactgctgtagacagtttatcagctcttcagcatatgtccattttccttgaaggatgagcctttagaaacctctgacaataaagtttattttacatccattcccttgcctatgattttttcatacaaatcacaattataaaactttcttgctccagctaaaagcaagaaactcaatcatgaatgtgttcactaaatatataccacagaatgatagcaaccagtctgaatgcatcacttgattccaaaattaaatgttagccctcagtggtgcaactacatgtatctccaactctggaagccacaggcaacatattcctgtttccttgcagggaaacagatctataagcagggcggcagtctcacacatgtacattcctgggaaacccaaggaaacaatgatagtgacgcagggcaggcaagcccccaaactgaaagagttttgctaatgtcgcgattggctttctatgttatttgaagactgagatctccatgaggaatgaagacaggtaatgcctaaggctgaggcatgacctcactgggtcaccttagctgtgaagtgaggtcagttgtcaccttgcaaaccttttggtaatccaaatcttggaatgatttctttaagaatttagacacttccagtacttttcctgtccttgtggggaaagcttctatccacctggtgaaagtgtctataaatactagcaaatcttgtagttccctgtaaggtggcatctgggttaagtctgtctgccagtcttcaccatggtatgttccttggtgttgtacaggtttaagcagggatcggggtatggggtggcttcctgagtggtaaccctttttatagtttagaacagtcccttcccgaagaatatttaggaaactaatttgaatggaaaatcccgtcccaaatgtgaggaatcatgaaaatgtttaattatttcccatctgtcagcctcaggaatagagtttgttcttttgtagcaaccatccagaggggtctccctggaagccttttactcagtccctttaatttccttaggggtatagtatggtgtcactgacacggatgcagtacctggtagtagcgcagcagcttgaaataccagggtttccttagttgtggccttagctgctctttccaccagggaatttcctctaataataaaagtgtctcccttctggtgtcccctgcagtgagtaattgttatttctttgggagttggacagcatctaaaagttccaagatctgagtaaagtcgtatgggggatcccttggctcttgatagtcccctttccttccctatggctgcatgagcatggagcaccaggaacccatatttagagtcagtcaacacattgactcttgagggttcatcctccccgcaggcaactggagatgtattgtccccagagggtacaatagagaatcttccgtcacaagtcagcaaccagcatatgtgagtgacagcatgtgtcccactcagaaatgagagtgtattagtccgttttcatgctgctgacaaatacataacagagtccaggaccaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccatcagatagtgagacttactggctatcaggagaatagcacaggaaagacccgcccccatgattcaattacctcctcctaagtccctcccacaacacatgggaattctgggagatacaattcaagttgagatttgggtgagggcacggccaaaccatgtcagaaagggatgaagtgacagcatatcctgatgtgtgtgatggtttcatgagttattatctatttcaaaatttattgcaatgtgtggaaaagaacaaggacttgtactatctgactttaaggtttactataagctatcagacacaaggcatcaagagtgacaaacggataaacagcctgagttagaaaacctgaaattgatccacagctatacggtcaataaatgggttttcagtaaaagcagttcaataaaagaaaataaatcatttcaattaatgaacttctatatggatgtggggagaccaacaatgttattctccctcacgttacacacaaaagtaatttcagccgcattacacaccaaaacttaaaagttaaagatataaagcatttcaaggatactttgtgacttgttggcaggcaaagattagcctaccaacaagcaggacacagaaaaaatacatatataagaaagacatgataaatgagacttcatcaacattagccacaccttctcatcaaaagataccactaagaaagcgaaaaggcaagcaagccacagacagagagaaaatacccacaaaacgtatctgacctccacatcctgcaattataattatagtggtctggtacactgcacccagtttctgctggatggagtattttctgggtgtctctaatgagtaagagagggccccatgggatattccttcagttcccagatgaacagtgggaaagactccacattgaccaacctcgggggcctgaaaacccaggtcctcaaggagggtagagtatacctggaccctgacccagacccctggatgggctgtgccaagagacccagcaagggaagggatttcctcctgcctcaggttctctgttcttctgtggttagaccacctgaacccaactccctccccaagcactagagatgggcttttccaagggctggggatcttgctgtcctgaggacagctgagcaagggggtcgaggaggagcttgggttgtggaggagaggaaaccgggtaagatgcgtgaagcagttggctataccaggcacagagaggacccgctgggacccaagagcctgcatgtgaagccaggccttgggccaccttgtctgtcaagggggtgcctacttccatggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctgatggagcctgaggcaggtgtgggaagatgtggattgtctaactggaggttgggagtccagggtgtagaagcagcttggagtgcaggatttggtggtacgtgtgtggcagtaggcaaaagaaagagacaactggccgggcgcggtggctcacgcctgtaatcccaacactttgggagaccgaggcgggcggatcacgaggtcagatgaagaccacggtaaaacctcgtctctactaaaaatacaaaaaagtagccgggcgtggtggcgggtgcctgtagtcccagctactggggaggcagaggcaggagaatggcgtgaacccgggaggcggagcttgcagtgatctgagatcgcgccactgcactccagccactgcactccagcctgggtgacagagcaagactctgactcaaaaaaaaaaaaagaaaagaaaagaaaagaaaagaaaagaaagagacaactgagccacttgaaataccaagagaattcaaatttagaaaattcccagggaactatgcgtgcaggcactcaccagatccacaaaacagctgctgcataactgcatgttgcaagcaagccctaaattgctgattttgaaacagcctgatgggttcacaaagacaatttctgaatagtcgtaagagcagaggtgcactaaagccactgtgccccgcaggcccggatcccagtaagttctttaaggagtaagtcttacttccatttatggaagatttttggagttgtccttggtcacccccaggaatgttttggttaggagtagaattttagatgtcatcaatttaaaaattaaaactaaaacgctggaactcatagagagataaaattaagagaatacattcactatcctgagtagaaagatttcttatagaacataacaggctttaaaaataaagaaaaaaggccgggcgcggtggctcacgcctgtaatcccagcactttgggaggccgaggcgggtggatcctgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaagaaaaaatatggcaaaatttcatctaattaaatgctttgagaactaaaattaaaatccaaagccactggacagactgcttcttggccaaggagaccccagagaagtcttaaatactgagttcctgcccagtagttggaatctcagacacctctccttatactctctccctttgtggtttagacacaactgaccagcattattgttaaaatagagatcctaagactgacagaacagactccttgcagtaggaagatacggtatgataaacgagacctaaggccacgccaggcaaggtggagtcatgcgcccctcaacttaaagaataaactatgttctaattgccacaggtctttttcttcttcctttttttctctagctaaacaagcactggccttgagataagcaatgctgaagcacttgcagctcacccattaccataaactgactgagccctccctacacaagccataactacagctttgattggacaagagactgatttcagtaacttccccttgataagagagcactggctgtggacgggttctggacggtttacagaggctgtgcacttgactgcctttgtgtccctgcttccccttttgaagcatagggcctaattataatgtatttaaatgttgtctccaccccaaagtgaacatgggttgcatgtaacaggcatgtttactcagcatgcatgcagcaggatcccttcatgaatattcagagctcctcctattccctgttgaatatgtatatgtggcccaccacatcaacataaatccctgttcccccctcccctccctggaaacgtacttttcaggtttcagcagcaagagggtatgcctccctgtctgtcagaatggccaccttgcaggctgtaaccctttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaaaatcacaagcattcttatacaccaataacagacaaacagagagccaaatcattagtgaactcccattcacaattgcttcaaagagaataaaatacctaggaatccaacttacaagggatgtgaaggacctcttcaaggagaactacaaaacactgctcaacaaaataaaagaggatacaaacaaatggaagaacattccacgctcatgggtaggaagaatcactatcgtgaaaatggtcatactgcccaaggtaatttatagattccctgccatccccatcaagctaccaatgactttcttcacagaattggaaaaaactactttaaagttcatatggaaccaaaagagagcccgcatcgccatgtcaatcctaagccaaaagaacaaagctggaggcatcacgctacctgacttcaaatgatactacaaggctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccttatttaataaatggtgctgggaaaactggctagccatatgttgaaagctgaaactggatccctgttctcattgcttgcacctgggagacacaggttgcagtgaactgagattgagccatggcactccagcctgggtgacagaacgagactacatctcaataataataataatagtaataatttactgttctcataaaaattagcggatggggaatggaggcaagccggtgcaaaccatgacaactagtttagattttattgtcaactcatgaaaaactcgttctcattttgtgtttttaaaaaattccactgatacagccgttttctctaccgaaaaagactataaccgcattatttcatcactggaagctacagacagagggcccttgagaggcggcatcttcacctacgggaatgtttcctgctcaattgtgagacaaagagcatgtccaagttttcctataggccaggccgccccctagtttctgcgctgtgggctaaactccagaagctggcgcccttcagggccagaggtttcctgtgctctctggaggctgctaggattaaaggcaaagcaaacgacaggtctattagccacagttgcaggatagaaaacactactgtgactcagattagaacagaggttgtggcaaccacaactacaagtattaaccactacacgaccacaaagtctgctgacaaccattgcacttcttctatttttttaatgtaaaaacactcacactattttatctggtttattctaggacgtccgcagatttttgtgcttttctgtctttcatgtgcttctccctttctctccccattctgctacataatttaaaaaaaatctcttctctcaggatccagccactgcctctacaacaagcctcctgggaggtctctttgtcccattgacatctctgccttctttcgctgcttttttttttttttttttttttgacggagtctcgctctgtcgcccaggtggagtgcagtagcgcgatcttggctcactgcaacctttgcctcctgggttcaagcgattctcctgcctcagcgtcccaagtatagcgtcccaagaatagcaggtgcatgccaccacattcggctaatttttgtatttttagtagagatgggatttttccatgttagccaggctggtcttgaactcttgacctcaagcgatccatccgccttggcctcacaaaatgctgggattacaggcgtgtgccaacgtgcccggccaaatttcaggccaacacctgttgacacacattgccagacacacggaatccctcgcggaacaccgatgggcccacaaaacacgcgggggctgcggtcgctgatgatgtgagcaaattcgattcacggtgtctggggtacagccctgagggttcactggccacctctgcgcaaggaccagtctccgccgctcccctcatctccacgcagattcttgcccacacacctcccctttctttgggccgatgacaactcttggacctctgaggtgactgtcctgcccgcagcttctctccttccaagagtgtcatttcttgatcctctccatagtggctcaacggtaagcccaaggtccagcacgcgaatcaggaaactgatggttctttgggtttgcagggatccttccagtgaataaatgaaagtaacaggtaccagtatcaaaactgcagtgactcaccagagacacttcatgcttgccagcttgctaagctgtttgagtccaacaactgcatggggtcctgggttagtctcctgccgctactttggtgagtgttgttgtcactttaccttgtggtggccaagcccctaaatgcactcttgggttatgcagtataattttcagcgtaaaagacaagtaaagagccatagcgaagtgaaaaacaaccacgtgcagtggccgggaattgaacccgggtctcccgcatgggaggcgagaattctaccactaaaccaccaacgcctctctggaactaccccctggaggataacagaaaagagtaaccacaaagatttagaaactgttctaagcggttttttcaagtgtcgactaaaagctaacaaagacatccaaaccaaatgtgtttttataggaaacttttattagacaacgttataaatatcaaaatagctcatttgtcggatcaaactcttaactctgaaaaaggtctttctacctgcattacaaacccctataataaaacatcagaaattcattcatgtttcttttttctaatcctaaatcttccatcatcaacctcaaactgctgccttagaggttctgagaaggtaacctaactggtagtttaggtaagtaaagttcaaatccagggaggaaataagaagcagaagcagaattagaagaaagacgaaataaaaggacagaaccacggtagagataatgaagaaacaaaggttggtccactaagttagtcttttgtcgttggttttttttggcaaaagagtaatgatcggtctcgtaatcattataatactattatttgtctgcttgaagatgtataaagcatttgaaggaaatgtgatgtgaaaagatgaagaacgcttgccgtcaatgtttcattgtttgggagaatcccatttcctaagttaatatgctttgatgtgttagctatgtaagcagtagactagtttaaggaaatattgacggtcaaatattaacatattagtcttttgatgaagttcaaatattagagagatttctttcctcaattttcaatggagacattcaactgaagagacaaatccagagttttctccacatgttgggtctgggagtcattatgactttttcaaagacaggagctgtgacatggaatcatgcttcttctcaagctgagaagccaagctaggtccaggctgagtcataaacttgagcccaccaaggaaatcatccttcacattgacctcgcagagctttggctgttctctgttctttgcccaacacccaagacacacaccagctctggccaacaaaccttaacatatgatctatatcaaccaaagctacatttattcccaaatctccttctaaaatacaaacctgtactttctactctcaacttctaaatctaccaaggcctcatatgcatctgagtcacagatgctaaaacttaaccggttttctgaggattatttgaggaaggggtatgcatgcaaatgtatatacataattcatgtgatttaggaatatggactctatgacttccagatgcagatttagaacctttttaaaaaatattttgtttttgttgtcttgcaaatcagccagatctgcaacttaccagagtaaagccaaaccaagcgggacccttaggaaatgcgctaagatgtcatccactttcagtgtcagcctgtgaaaattcaggcgacagaagagaataaagagaatcttaaggaatttctggaaccaaagctaatattaagcaggcctcttgctggcagaccagtggaaattgtacctggtcaacaatctgtctagattgaggaggtctaaaatgtagccacaggttcaaatacttttctgtttgtttcccaacctcgattaaactcacaaaatttagggaccaaaaaaacaaacaaacaaacaaaaaaaaaaacaaaccacgacgttcccacccagtctcgaatcagggacttttctcgtgtgaggcgaacatgataaccactacaccacagaaactgcatatgcaccaaaaaaggcaaaatatcatcatgaaaatcttagatcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcctccgagccctgggcgccccgtgcctctcaggagggtggacgccgcccttccagggatgcggaccccgcctcggggccttttccccggcgccggccgtcggggctcttggctcttctcgtcctcccaggaaccgtagaaccctccttgccctccctcccgtaggccgaggggcgtgagctgcgcctgtttcctcacggaccctttggcctcagcgcctcgatgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacttactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacataagccataggaggcatttaacagcaaattctaccctgataaagtatcgcactaaaaattttagtatgggccgggcgtggtggctcatgcctgtaatcccagcactttgggaggctgaggcaggcagatcataggtcaagagttcgtgacaagcctggccaatatggtgaaacccctcctctactaaaaacacacacaaaaattagctgggcatggtggcacatgcctgtaatcccagctacttgggaggctgagggaggagaattgcttgaacctgggaggtagaggttgcagtgagccgagatggcaccactgcactccagcctgggtgacagagtgagactctgtatcaaaacaaaacaaaacaaaaatttaccatgccactgttcttcaactgttatatatatgttaattatatgtccctagataaattttttgggagctgggcctccagctgggatactctctggaggagactcttcaggtcctttttggcctgaagtcctggagagtagaaagccccagtgccatcagacagccacaactcatcctcatcagtgacactatgaggtgaagacccctccagggtgtcaggagctctcagcttccagggtctttccagactagatgaataatcacttgtaaccaagagggactggacccggttcttgaggttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttaccactgtgtgaaaaataggcataggaaaataagacttcgaataaatatatcagcatgttaacatcagtgtattggggcagtggtagtcagaatgagaactaatccacagcattttacctgatgccagacactgttctaaagcattttataagaatttactcatttaattcacattagtatctgatggggtaggtagttcctttattactattttaacatatgaagaaactggggcataggaaagtttacaaattgggatttgaagcaacaagtctggccccaggatcttttctcttaactgccacactacacttcctcaagaatgagagagactgtgtttttcttctcttctggttttctttttttttttttttagtttgtaagcaaacatttatagccatgattccacagatgtggtaagtaaaccaacagccattcctaaataaaatacaagaatttccatcatgcatagtttacaggcttggtaagaagcagtctctttaggggctagatgcttaagaaatattcaacaaacaatgaaatcttggcttttttttttttttttacacaaatgtttggttatttagccacattagtgataaaacatattcatattctaactgcaagtggaataaacattgcaacaaaaatgcaacccaatcaaaatcattagtaataactattactccctcttagcagtaagaaccattattcttggatttcaaacattttattttctgtgcatagcttatagcactgtattataggaatcagagtgtataagcaaaaaaatgaaataaaacttcttgaagaccatttccattatttatgattaaatcaatgaaactatacaatttccacattaaatacaaattagtaaaagaattcctccaagtagtattgcatataagctacaactttaccccaactattttaatcactatgattcgagatttcctaggatttaacagcccaagattgggctgttactacctcagcaagaacaatcaccagtaaatacatgaactggggttatagctgaatttttagaaactctccagacaaaccacgtgttagaggaggtaagtagaaaaactaatgtttgagctgtgctattcctaccaggaactatgtcaaatatgcaaagttcaaacattcttagtaaaataatatgaaaggatctatatatactgtaaatttagcaaaaacacttttatgtacagaagcctaaatatcttaggaggtttagaataccaatgaagagaattgttaattcttcaaggctggtttcttatgaggattaaaaaccagcccttagtctcagatgcattccacctagatgtgttcacgaactccatagagtaagaaatataaaccatgaatatgtactcttaatttccattcttcaacttaatgttctatagtacttcagatttttaaatccagagtttggtgtacacttaggaaattatagtaagagtagattagagaagatttgcttgttttccttttgaagccatgtgaaggtttattaccctgtgtattttcatcactgaaaagttccccggtgactaataaaataaaagtgtcacaagctacatgatggatctcttcttttaatgttgcatacagtttcagtttggctagtgagggctaactagctcagccctagtttcattttattagagttgaccactaaaaactaaataaggaagttaccagtaaagctaattcccaatacaagcaaaaaacaaaaacaaaaaacaaaaacaaaaccattcgcataataaaatatatccttaacacaaaataagggtataacatattctgcagcatgacattttattttatttctcagctgtagctttttcattcagaaattggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattatatcagtacttcccctgttaagataactgagtgccacctagtgttcaatttctgcaactactaagcttacaaattcaatactgctattaaaacccaggttctgaaaacggcattttggaaatcttttttttttttttttatgtttacggtggcaaaatacgactatgaaaagaacatgatatcaaaatcagtataaaaatagccacaggctacttaaatatgacaaacagacttattttttttcttcaaatgcagacttctgcctccctcaaattgtatcaaaatctcaagggaatatctaggtaactggaatatacacaatgactctatacaatcaagaggccagggcttaatcagattccgtgaggacaaggcaaatgatttcttcaaaacacccattttcttactggaagtggtaggaaaagcagcaatgcatggttttttttttttttttttttgtaattagtagacatggtcttctacccataagctccattacattaaaagaacaaagtgggcttaacatctcacttaagataattcagcattattatcagttttaaaaaaaccaaaaatatcttagaaacaaatcagtctgctttaacaaattgcattcatgctaatgaaattttaatcttctttgtcatgatcaaaatccaaattgtaggacaatcttcagaaaagatggaatgtaaaatgttgagttcaatttagatgtcatcaatatcttcatcatcatctccaatgtcatcaaactgaatttcatcatcatctccaggaccaaatgtatcagtttcattgattttagcatgctctggaagctcgccgtatgcctgcagacttctagcttcgtctgcattgtattttaaaattacatcagctttgttatcctggtagtctcggagaccaaccaaaataatgtccgaggtatttatccaaaccttttttctcaattttcctctgatgtgacataacctctttacaccatcgaaacacattgcttctagccgtccatttcccaacattttgattacctgagcatactcctgaccatcctctttgaataccagttctcttttttcagattcattctcattcttacccctgcgtctatttttacctcctttacctttattcttgggcatggcggtggcggcgacctcgcggcgtctctgacttctttccgggtagcggcgaccgcggcggctgctgctccgaggggcgacacgagggagcgcgcgggaccaagtaggtgctggaggccaggcaacgtgcgcgggagaggctggcgacccagctcttcggagatccgcctgcgtccacgctcggcggcagcaaaatgctcttctggttttcaatgtggtgggtggccctatggttgtagtccttttataatgcaaaacaaaattatttttaacttacggtttgcatgtttccaaaacctcatgtggtctctaagtaggccttagtatttctataataatcagttggctagaactttatattattattattattattattattattattattattagcagtgtgccacaaactaattgtagaaattcaaacttatacgcagcctcattttgggtaagagttctcctattaacctcctgtcctcctcttccccactacttgtcaggtgtggaattggccaacagcacccaaatgtgatagctgactccagggagggaaggtgagccccacaccctgtgctcttaccgggactggtggtttcctcctgttcagcctcattcttgctttggccacaagtctcatagcccaggtcctggaggtccacctggacctgtttactgtcctgcttcagcaagggttcacctgcgtgggaagagacagcaggtgttacagaatgtctgaatttcccacatatgccctcagcctcaatggcacataccctaaccttgtggggcagggagggcagatccacagtgcgagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccattgaagctggcaagtgctttatcagcaggggttcaataaatgttgaatggagctgaactaatttagagtcccaagacacctagacctgcactgtccaataaggtagttagtagccacatatggccactttatactaaattaactaaaattaaataaaaccaaatgtccaagttgcactagccacacttcatgtgctcaataaccacgttatgtctgtatagaacatacagagcttataagacgtacaggctagttctttactagtaagtcatagttacctactaagtataactctgtatttctccagctcgttcgcctgagcaaagacagtggcttctgatagcagcagcttctcctggagatcttgatagcgttgtttgcattgtgacagctgggagcgcaggtgctgggtggaccctggtgggctaaacgctgattgggcccagtgtcacaaggctgggactggttctccaactgtgaaaggggccaagacaaggatcaggacagtccgaggccacccccatgcagtgatgaccacggcccgttgtgaaccccgtggactttactcaagtctgtcacagcacttctcatgccatttggcagtgacttgctttccagatggagctcctggagtgctgggataatgttttcttcatatctgtatccacagcacacagcacagcgccaatcaagtctacagaggagctcttaggaaacgttttctcagtggtcaaaaagagaaggggtggaaccctccactcatctcccctcacattctgtgccatcgattctctcagaatcccctgtattccccattttactgaatcttcagcatggctcctcccctaaacaggatcccaataacccatctgaggtccaggaacagacacctgtgatgagctgtgaccaaaaaaaaaaaaaaaaatggcattgataaggaagggatgtcattacatactacttgtctgggctgcctcataacctgatgcatccctatgttacagcagttaccccctcctattaaaattacctgtttatgtgccatctttccttaccatattaagtatctcaagggcagccattggttttattgccccatgccaatgcctagtgtgttatctgaaaaattaagtactcaagaaatatttatattgtaaaaggctttctaaaggctgaatgtaggctgaatattattactgttgtttgtggtacaaagagacctttctcttggtacctcttgattcacatgggagaacgttttaaagtaaacactgtcatctcgagcccttctccagtggtttttcattccatctaagcctacattgacttggtgggcatccactgtgaaggtagccccaaggtcaaggctctggggtctggggcaaggcctcacagtcacattcccctcctcttggtgttggtgcttcccaggagaaccaaccagttctgtgtttattctgtcgatggtgctggtcagatgcacaaggagctctggagtaagtttactattcccttctttgctactcagcacaagttgttcttgaggaggttgatgatattgtgggcattcttcagttttccctggagctttctgaactcagcctgaagactactctcactcagaccctctttggcaaccacagtctcaaccaccaccttgcccttctccttgtcttcctcaatctcccatccctcagacatttctgctctttcagctctgcattctcaaggcaaagatgggttctgggtctccacagttgccagacttttctccaaagccaccttgaggaactaaaagaaaatcatgctttgaagaagttaggccattaaagagggcccaagagaaacatgagattgcaaaggtagtttttgatgagaacaaaaacaaacaaaaaaagcagatctaaaatgaactccctacccagaacctccttagtcaggcaataagagcaataagatctcaagactaagttttattattattattattattattattattattattattattatttgagacagggtctcgctctgttgccggggtggagcgcagtggtgagatcatggctcactgcagccacgacctcctgggctcacgtaatcctcccacctcagcctcccaagtagctggaaccacaggtgtgtgccactacacccagctaatttttttttttttaatcgagacggagtctcgctctgtcacccaggctggagtgcagtggcacgatctcggctcactgcaacctctgcctcccaggttcaagcgattttcctgcctcagccttctgagtagctgggattataggagcgtgccaccatgcccagctaatttttgtatttttagtagagacggggtttcaccatgttggtcaggctggtcttgaactcctgacctcaggtgatcattctgcctcagcctcccaaagtgctgggattacaggcgtgagccactgagcccggcccacccagctaatttttttttttttgaaatggagtctcactctgttgcccaggctggagtacaaaatggcgtgatcccggctaactgcaacctccgcttcccagattcaagtgattctcctgcctcagcctcccgagtagctgggattacaggcatgtgccatcacacccacctaatttttatatttttagtagagacggggtttcaccatgttggccaggctggtcttgaactcctgacctcaggtgatctacgcgcttcagcctcccaaagtgctgggattacaggtatgatccactgtgtgcagccccgtgcagctaattaaaaaaaattttttttcgtaggcctggtgtgaaggctcatgcctgtaatcccagcactttgggaggctgaggcgggtggatcacctgaggtcaggagttcgagaccagcatgaccaacatggcaaaacccggcctctactaaaaatacaaaaattagccaggcgtggtggcaggcgcctgtaatcccaactacctgggaggctgaggcaggagaatcacttgaacccaggaggtagaggttgcagtgagccaagattgtgccattgcactccagcctgggcaacaagagcaaaactctgtctcaaaaaaaaaaaaaaaaaggccaggcttgatggctcatgcctataatcccacaactttgggaggccgaggcgggtggatcacttcaggtcaggagtttgagaccagtttggccaacatggtgaaacccatctctactaaaaatacaaaattagctgggtgcggtggcacatgcttgtaatcccagctacttgggaggctgaggcaggagaatcacttgaacccaggaggcagaggttgcatgagcccagatcgccactgcactccagactgggtgacaagagtgaaaccccatctcaaaaaaagaaaaaaaaaattttttttttttttcagaatgaggtctcactgcattgcccaggctggtctcaaacttctggactcaagtggtccccctgccttggcctctcaaagtgctgggattacatgtgtaagccaccatgcctggccaaagacttacttttacaggaggagtataaaacatctcattagtaattttcataattgattatgtgtcgaaataatatttttgatattttgtgtcaagtaacactactaaaattaagctcacctatatccttctacattttcactgtggctactagaaaattttaaattacatctgtggctctcattacatttctattggacagcactgggctgggtgagatgactaggggcagaaagtacattctgagggccagacaatcaaggtgattgatactggggttaggttaactgaagggtagaaaaggccaggttaataggaggcagggactgagtaaccgggaacaaagttatcagagcatgagagagagattctgggggtcagccgtctgggatattatagggaggaaggaggctgtgctacaagggccaagagacaggaggatgcactcaagttggcctggatgaagggacgaccctctgcgacttgggtgggggtaagggtggcaggctggggccagccctgcactcaccgcttctgcttcctagaaggagaaacagtgtcacttggtacctccacctcaggggcgcagtcaagacccgctgccaggccagcctctgcctgaccgccggctcacctctcttcttccagcttcttccgcaggaggtcccacctccaggcgggcatgctggccagccgggcctcctcctcctcctgaaacacaaccacaaagcttcagagcctgcaggggctgggagatagggggcaccctcaacctggggacctgaaggagtcagggtcacaggaagtgaccctttggatgcatttctgtgggacaagtggatggaggtgcctggtcacaccccctcagagctggcctcctttctcctagtaacccagacccttgtgtcctacaggaggcaccagagagatcagagctgagtgggacagaagcagagaaaaagtagccgggacccagaggtcctgagcctgattccccacaggggcaggtggccaatggccacaggtccaagatctctgggcagacgcagatgcgggcccccacccagcctcttggctcagggagattcaggctgcccctggctcccctgagaaggaccttcagcccatggttgccctcttcccaacagagtggatacgtgctctacaatcgtggggctgcaatgacatcaggggcaggtgtggtgtccaacataggcagtttacagcaaacagttttatttcctgaatattacagaggagaaagggtctgtacaccgcacacttcacacagaacactgcacacgtggctcccttgacctcagccaaggaggtagctgtgaactccagtggaaaaccagagagcaggccacactgccccagggaggagccgcagcccctcactcagaggggcttcttctgctgcctggctccacacagagctcagcaagaccacggggccagagggggacacctggtttgttctgtgcctgccctgcctatccgaccaacgccccacacaacctgctcacgatgggacctcagaggctgaggcagcctggtcctgggccctccgggctgctcaaggccacagtcctgggttcttcccgctgcttcacgcctctggagggcgtcagacaggcgtccaggcccacgttaagacgctcgagggtgaactgcgaattccgaattccgctgctcagatgtcaaacagctctgcctccttctccttccagaaggagaagctgcggtcgatgtagcggcagatgtcctcgttgctgaattcgcccatctcagacactagttccaaagggtcttcggcgggggcttcggaacccggagagtctgagatccggggaggcgcggcggggaggcgcggcgggccggcgggcgggcgggcggtggcggcggctgcggcacaggggccagggcctcgcgctgccccttgggcgggtcccccttctgaaccggagcggcctcttcggtccgctcctgttctttccccttctcttcctttttcttcgcctgttcttcgggggccggcccagcctccaggccgtttccgaagaacctgtgcctgaggtcctcgaagccgtcgctccagccgcgccggccggcctccacctcctccagcaccacgcggtggaagaggcggatgcgctcccacgggtggctgtccagccggtggaacatctcgtagcacagtaggtggcggaacttgcgatcctcgcggctcaggcccatctccggtagctggaagtagccgagcatgaagaggtcgagcgtgaggctttcgtagcgcgggggtgcgccgccgtctaggggcgacaggaagtgctggggccagtacacgccgtgcgccaggcccgggcttggcggcacgtgccgccgcaggctccgccagtggtgcagcagcttgcccactgcctgccgctgcctcagcagctgccgcagccgttcgttggggctgtgggcctcgcccttgctcaccggcagccggggggcgtccgtggcctccagctccggccagcacgggcggccgtcacgccagggagcagtctgcctaggcgcgcctggtccgcggaaggcccggtccgaggaaggcccagaggcgccagtgctccaggaagaggtaaacgatgcgctccttgcgcaggtcgaggtagtcctggacgccgcgcagttccgtgcagaggggcggccggcgcgccagctgctcgggctcaagtagcgccgcctggcaatcctgtgcctcaggcgggcccagggtgtccaggggctcccagtcggccagcgggccgtgggcggcggcggcgctgggctggccagagccggccgccacgtagtcctcctacaggatgggctcgcggaccggggcgccagcggactgcgggggcttgcggcgcggacagcgcgggggcgccgcgtccagtgcgcgcagctcgtaggtggcgcggtgatgctgcacggagacgccgcactcgaggatctcgcgcgccacagcctcgcggcaccagttgagccagtgcgagcggcccaggcaaagcggccccggcagtcagggcgcctcaggcagcggcgccagcggctggcccgtgtcagcggtcggcagctccgccaggtgcgcaggccggccgcccagcgcggctagcagcgtggccatgctcttgagcagcgtggagatcttgctgcaccaggcgggcaggctggcggcgcggccatgcattcggcgcgggtcgacggtgaagcgcggctccacagggcgacggagatgggcagcagctgctcagctccagttgctccaggcgcgcctccagcttctgcgccttgtgcagcacctgcaggttctcgattgctgctcgatgcggaggatgtcggcctcggtcatgagctcgccaaagggccagaggatggcgttgtgctcgcgggagtacctccagccctcgcgggggtacctccagccctcgcgggggtagcagcacgagctggcggccgtcagctaaggcggggaagacaagagaggggagggaggcgcgtctccctctggcccagctcccgccgtggcgccaggaaccttttgcatgtcctgggtggtgtaatggctccgcggggctgcgtctgcagggagggaccgcgtctggccggcggggggtgacgctggggtgaggcttcggcctgagccgccgctccaggctctgggcagtgtccactttggtcgctggcggggggcacggccggttgctgctcgctgctgcggcggcaagaacaggccagcagacggggtctccatgcctggcttgttcgctcattacaccacccaaggaacttgccaaaggccttgaagctgagaggcgcggtggcccgccccaacccatccgagggcggctattgtgaggcctctcctcccagactcatgaccccttctccagctcccctgtggcccaagccttccgctccctgtggtcaatgttttatgtgcagaatgagaggccactcctctcttaaagaggctgcagctgcagcttccactgagctgcccacccttcccctcccttcgtcgtgctggacagctgggcaccgtaatattctcatttgctcacttttctccacctctgatgtccagttttcccccctgggcctgccatcgcctccacagaggtccctgattcatcttggccctatgggatccactccccacatacaaataggaagcagcctcttccctgcttaacactccccgcacccggctccccagtgctccaggagaaagtccgttctcttctgggcctctggccaggtcttggtaacctggcccccactgaggtctctccagctcagcgacccccttcctccaggacagtcagggccacatccactctcacttccagactgccctgtcccacctgcggctcttcagccccctctctgcctggccacccctcactcgtcttccaagtgttaccttagacatcacctcctccttccctaacacaccccccagcccacgtataaggtggccggttagggctgccccagtcccctgcgttccccattgcagctggctgtgttgcatcagcccaggtacttctctccactgccacccactctctcacactgccccattttgtgtgcttggtgactcgcacacatgtccgcagccaccttagagcaggccttgatatgttcaccatgaatccccagaggctacaagcgtgtggggcacataaatggcactcgggggccaggcgtggtggctcacgcctgtaatcccagcactttgggaggccgaggcgggcagatcacttgaggccaggagttcaagaccagcctggccaacatggtgaaaccccatctctactaagaatacaaaaattagccgggcatggttggcgggcatctgtagtcccagctactcgggaggctgaggcgggagaatcacttgaacccaggaggtggaggttgcagtgagtcaagatcgcaccactgtactccagcctcagtgacagagtgagaccctgtctcaaaaaaataaaaaataataaaaataaatggcattcggggaatagtttttggatgaatggaaagcaactcatcctgccagctggtgctgatcagctcaccttacagagaaggaaactgaggctggatgaggctcagtatcggcagctggaaggcggcagcgcagcaatggagaccaggtccctaagactgagaccaaagctctcttggctactcagtgtggtccttggaccagtgtcatcagcagcctcacccaggagctggctagaaatgcagaacctcagccctgcccagacctcctgaatccgaacaggccttttaaccagatcccaggtgctgggcaggtgaaggagagtctgagaaaggctgctgtctcactccaaggacaagctgctgggggtgtgtgtggagactgggacaagccccaaacggggtcgtgccaccctgatttccctaaagaagatggccgggcacagtggctcatgcctgtaatcccagccctggccaacatggtgaaaccccgtctctaataaaaatacaaaaaaattagctgggcgtggtggcatgcgcctgtaatcccagctacctgagaggctgaggcaggagaatcatttgaacccaggagacaaaggttgcagtgagccgagatcgcgccactgcactccagcctgggcgacagagcaagcctctgtctcacgaaaaagaaaaaaagaaaaagaaagaaagaaagaaaataggaggtcccgaggttggtgttgggggtggcgtgggggatgggctgtgcatccagatgcagaccccagggctccctgggcaccccgccccacccactttccacctctgctcctcctcctcctccatcttcagctgcatcttgcccaccatcacctggcgcttccactcgggcttgggacggccctgctcatcgtgcgtggggatgagcgcctccacgtccagctgcacccccggcgcaggagtagtgggcggcaccggaaccaagcttccgttgagcagcggctgaaaccccgcagctggcggtgtggggctccggactggtaacagtgcaggtgacacagacggcagcggccaatcgggctgcagggagaagcggtggggctgagcgcctggtggcctagggccagggaagccgggtcgcaggctcctgctgggcccgcctacctggaaggccggctgcctgctgcctgagaacactgtggtcagccccttgctctgtggcgtcggcttcaggctcttgcctgccttaatctcagccagtagctccgagttgtcgcccatcgggaacatcacgttgaaagacttggtgcctatgcagaggcaggagatgaggcactggccagggtggggctgcatccctgccacccctcacccgcccctctgcagcccccttcccaactccagattggatgggtgcccatcctcggggccagcgggcagctctccagatcccaggtcctgcaggcagctttcagggcccccagaggcaggcccttggttccccgactgtggcaaccccaccatcctcccccaccctactcacgggatggagggcccctgcctggagacccctgggagttcatggtggctcttgggcatatattcctgcccagccactgactgcccagccccaaaacactacctggaatcagccaccggacctttgtcccaggtttcctggctcagcccggctgggtggagcctccctctggccctctccctacatcagcaaagcctcagtgacccttgagctgagtcaattggggcctccatggacatgcagagtccagaccccagagtgccagtaccacctgctcccctccctcgccaccacacccacagacagacgcacaagcagacacattggttgcaagccgggagcacatttatggcaaagcacggctcagctctaggggaaagcagagcccttactaaggccacaggaggcacccaggaagaagggcagcaggtaatatgcaaacacccagggcagagggtgcattttctggcttagccggaggaggcgaatggagatttggagagataggtctcttgagtcccgatgaaggggtcaggtctgggagggaggaataaaatgggccgacagctcttggattcccaggctggggatcccagagtgcagtcaccgggaggagaagagtaggagaaagggaaaatcggtgtggcttactcatttatttaggcaaaaccatcagccaggcgcagaatgcttgggtgcatatgtgggtatgagggtaggtatgaggtgcaaggccccacccatgcatcgaggttctctcgcctgccagcccctgcccctgccctttcctcaaggctgggcccctcctcccgtgcttttcctgcctcttccccccaccccgcgcctcagcctcagccaggagccgcgcacgcagctactcactcttcctgtgcctcaggactctcacttctagggaccaagaggagagaagtgacagcggagttaggagggaaagggggccaggatgagactgggatagcaggggacagggagcgggccagggagagcaggaggggggaagtggagaagagaggaggagcatttctgcccatctgaccctggctcaggctgctctggggccccatgagggtggtccatcgagttcctggtttggctggtgcccctgagggctgggcagggcagggccaccagtggctctagcccccagcaagggcctccaccttggcactgggttggggtagggcacccagccctggctgtgctgggtgggggtgtctggggaagcccagagtatatttttctctgcccttagcttcagccctgctgcagactgtggagggaaggagaaggaggctcggcaggtgctggacatgcttccatgggctctggtctgcaggggctggggctccataggaaccatagggggacaagctctgctctgcactcctagtcagggagatgaagctttgaggggtgccactaagcatgatctctgccctgagtggctgggtgatgaaggcaccccagccaggctgggatgggagcaccacatctaggcaccctgtcctgggccttctaggtgtcctggcagggggacactgtcccaccctacagaaaagaagcccaggaatcctgcgccagtctagctcttaaaaaggatgcctagggaagtcaccggggagggagggggaaacatggtgggtcacagctttgcccccatagccaggctctggctggcccagggcccctggcaggaactggctaggaagagttcctggcatatctaagaaggcttcaggtctgtgctgcttggaaagacaagagaaagacgtggagagaggaagagaggctcaggatagacaggggcagggggaagggtggccagctgcggggcctctctgaagctggttcgacttcaagtgtccctccagtaccagctcatcagaaacaccagcaccagctcatgggaaacaccagcgccagagctggaaggccctttctagcccgtgggaggcaggcccagagaggggaggggacttgtccaggccacacagctagagggtgggaggcaggcccagactggggaagggacttgccccaggctgtgcagcccggtcctgctttggcaggacctcaagcaacccagagccctctcttagggtcaagtactcaatgcggtaggggtggccggaagaccatgtagaagaggaaggacccgggcagtgacagctggggagggggtggtgtctagatttccctcccctttcagggctagcgccgccccccacccctcaacctgcccctactcactgccggtgggcgaggaggagcggcgctgcccgcagccagggccagcgccctcgaggggcagaggcgggaccggcggcggcgaactcgcggcctcgggcaggggcggcggcggcggcggcggcggcagctgctgctccctggacgccttggggtccgcggcgcagccgttaggcacgtggttcccagggagttccgcctgcggggatgaaggtgggggctcacctcccagcttagggagaggctgaggggtctgggtcacatctggccgggggcgcgtgcagagccgcggtcaggtgtggcagagcagttggggcccacgtagcatccgcgacggctgcgccgcctgcgggggagcggaggggccttcgagcgagccgcgggcggcagggccgaggcgcgggcagccggcgggcgcgggctggcgggcacgcacctcctcgcggtgcgccatgcccgggcgtgcgaccagcgtctcgccggggcagcggcccagctgccggtagtagtcccccgtgctgggctgcttgctgaaagcgcggggcttgcggctggagtcctgcctccgtagcccgtcgtggccgtcgcaggagctcggctgcgggaagacagtgaccggtggggctcgggcaagtgcccggtaggcgccccccacgcctccccacccagctcttcacctcctgggaactcgcggccagcggccgtcggggggtgcagcagccgacttcctagaccccctgttctcacggtgggcagcgggcgaggttcatgggggcctcggtggaagggcaggctccgcccgccttacagggaggggttctgggcaccggccaaggggcacagggtcccccactgaggccagaaggggcgggcccaggggcgggccggcccagccccgacgccagggggagctagagaaggggcacctcccagcttagccttcactaggccctcggccgcactccgctctcggctgtcagaaggactgcgggtccccagggctccgcggagccctgtctttcgggggtcccgggccggagggagccccctccagagcctgtgctctccgaggctccggcttgccccggaccccgcttgtccgtctaggggctgctccaacctgccacggtgctggtggtcctgctgtgcacctggcggcgggggcggcaggacccgacacctgctttacgtgatacttcctctcaggttacagacgcccgcgcacggccagcctatgggctccgacggcctgacatcacccggggcccgccaatcccaggccgaaccccccccagccgtcgcggatgccacgggggcgccaactactctgccacacctggccgcggctctgcacccgccccgggccagatgtgaccccgccccctgcgcctctccctaagctgggagctgagcccccaccttcatccccgcccgagaggagagagggctgaccgtgggcagagggggcctctcatatttggctgccggctccgggtcgcgtccccaccgtttccctcctgcatctggaaaccatcgccatccacgaaagcgacaccgacacccgcgctcaagcctcggatttcaggggccgtaaggcggggtcgggtgacagcgcggcttcccgccccgtcgcagctgcccccaactaggcccagctcagtgagggagagtgaggcggccgggccaaagactgagtgaccgggtgggggctgtcccctgccccactctccagcccatgcgtccctgcggtggcctcagacccttcaccccgcccgacctggctcacgttgcaggaaacgcgacaccgcaggattcgttttctgggccagcccgccggctccgcgccccctgcagcccggaggctccgacgccacgaccctgctcccacctgcggtcaggcacccgcgcgggaggcgccgcggcgacacaaagagccctttgtagagcttcccggcccgggccctggcgtctgcggcccagcacgcacacagccgggagggacgcacacagccgggagggggctcgcacagccaggaggtgacctcacagacctggcacttgggctcagcggtggagagggggcactggctgggccacctgtcctgtggatttgggcggggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcaggtttggtgtccctcccatgcctcccttgcccactggccttgtgacctgagtcaccttgtatgaattggccctggggtggctttgccttgggcttaagagagaactgcaaggtcccaggctccagcaggaccccagggagctgccacaccacatctggccacctgtgacctcaggctgtcccctcacctcttagaccatccttgctctgttcctgtggccagaacgccagtgttccccagggcaccctgccgaggatacccgcaattgctcagaccagacctctgccccaatccctgctccagagcctcagccaggcgcctgcaggccccagacatccctaggcacctcacacttcacctacccaccctgccctcatcctctccacacaggctcgcttccctccagggctcccagctcaggcctggccctttcccccaggagctcaagccctaaactggaaccagccacagcttcacttcctcccagcccctactgccggtgggcgcccagccctgctagtgcctgctcaccttcctccctccctccttccagcccttacctctacagccatgccactggcaccttccacctggcagccacctcccttgggtgacactctccgactgagcctggggctgtgggggtgggggggcatgcttggggaggggcagtctccatgcattctctgtcaactccatgacaacccggccactcctgtgcaagaggtggcacaggcccagttcctggtgaggaacagctgtctggacctgcgtccttcaccccccagctcccatggagggcagtgacctgctcttactctcctcccagtccagtgtccagccctgacccctcgtgggactcgccaggagctttgactcttgaatatgccatggacccagggacccccaccctgtgcccactagtgaggccaggcctttggcctgactggcccccatcagcccagtacccctgctgggaggcaggcagtgggtgagggctcactacctccttcttgagggcctctgtctccacgtggcggagtttgttcttggtctgcatgtagatgtcagctgcctgtggtcccacaggaggcttgggagatgggtagctaggtgggggtgggggcagttgggtgcctgggggcgggggtggcggggggaagctgggtgggggtggtgggggtatgggcttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtacacctgttgtggcccctggcgttgctgggcttcctctccctggccctgccctgccccagcccagcacttattgggggaagaccaggcactccggtttggaggggaagcactggaggctttggtgtgtctagagggcagggtcacctggaaggggagggtctactccttgggagtacagatggccacatccaatctttgcagggcaccctgccaggtctggaggccaccatctggtggcgtgaagcaggcattgcaagtggatggacgcccatgctcagggcacggtcagggtgtgtgtacacacaagcctgcagtctgccgaggcgattgtgaatttgtgtatgtttgagtgtgtacgcatttgtgcacatgcttctttgtattgatgaatgtgtgtgcattgctctgtggacatggtgtgtgtgtgtgtgcatatctgtagtatggaaatagagcattgtgtgcttgtgtgtaaggtgggtgtgtgcagatattagcatggctctgtatgtgtgttcatatctgtatgctgtgtgtacacatgtacaagtgtgtgcttttgtgtgtgagtagctaagaataatgaatggtgggtggcacacgtggattttgtgggtggggagagtacatgtggatgtacatgtatgtctgtgatgagcacacacaagtatgagtgacatctgtctctcaccagaaagggtgtcgcctccccatgtttaaaagcaagtgataagagtagtctccgatattggctgtggcaggctggcccaaggccaaccctcacagcccagcagtctggcttcagtctgctctccctccccctcttcctcctgggcacactcaccacgtggagggtgctggcccttgatgctggagtggctggaggagcaggagtcgtagttggagagggtgctggtgggcgagctgaggtcaaagttcagaggctggaccgacaccgtggtgttgggtgaggacatgcctgaatccggctgcttcgcctccagctccacggatggatcccgggagagcacgcagtgctccatgctctgaaggggaggcagggaggccatgaaggcaactgcaccccaagatgcgttgctctccaggccagggtcctactcagccatgcctttgccgtgggatcttggccaagccacacccctctctggggtctcttccccatcgctagagggtctttcaggttcctccgggttaagattcaagcccagccccgccaggcagaggacccaggttcctgggaaactccctcccctggctcctccctgattaggagggtggagagatcgacgaggagggggccttgagctgcaccccagggggagaactgccaggagatcggccttctccctcacagatcggcacaggctccatggggaagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacctaagaagtgtcacaggcaccctgggagagagaggcaggcctggcaccaggtaacggctcagcggccgcgctcattggccccgtaattaggggctctgctggagtgtttgccttttctgggccagcgtcttctgtggcttgggtctgtccctgcctcagctgggcctgcttgagtgaggggaccagggcacacacaccccacccattccaggggaccaggccctgttacctaccgcaggagtcaggggagccataggaggtggcatgggcagcacccaaaggtgctctttacctgggcaacagcagtgggtgctgagggcaccaagccctgacccctgtaggcagcagataagaggctgggccacagcaggtgtactgcgcctggcctgagccacccagctctgcagtctgggactgtggcttcaaactttccctccccgacttactagctatttcaggcgagtcacctgtgctttttgtgcctatgtttctttatctgcaaatgggggtaacagcactacttgctctgctgagctccaggacatggcgcccagtaaatgccatactgtcaaatttttttttttttttttttagacggagttttgttcttgttgcccaggctggagtacagtggcgcggtcttggctcagtgcaacctccacctcctgagttcaagcaattctcctgcctcagcctcccaagtagttggaattaaaggcacccgccaccacacccagctaatttttgtatatttagtagagatggggtttcatcatgttgaccaggctggtctcgaaccctgacttcaggtgatccacccgcctcagcttctcaaagtgcaggcatgagccaccacacccggcctgtcaacttttttattttattttattttatttttagacggagtcttgctctgtcaccaggctggagtgcagtggcgcggtcttggcttactgcaacctccgcctcctgggttcaagcgattctcctgcctcagcctcccgagtagctgggactacaggcgtgtgctaccacacctgactaatttttttttttttttgtagttttagtagatacggggtttcaccatgttggccaggatggtcttgatctactgacctcgtgatctgcccgcctcggcctcccaaagtgctgggattacaggcatgagccaccgcgcctggcctgagccactgcacccagccaactatttttttaatgtactgtgaagagtaactgagattacacctttaaggcactcggcagggtacctgcctaagtcagaatccaatgaatagtgtttgctgtcctatgaccactagcagctgcatccagacaggccctcaggtgccctgggctctggtgccaccccccatggtccctcgacagagtcacaggctctcttaactgatggggacccaccactgatgcagaaatgtccttccctgtgtccatcccggcttatataccctagtgacagagtgctgactacctgctgggccattcattctcttccagagactctttctcggggggaagttcaccctcaggcccacctgcagcctctggcctctgggccttgctgtgttctgcagcccccagagccaggaccatccccctgtgctggcagggacgacagatggacagacggtgctcagggcacagaccatctgccttcttccctccgggcctcatttcacagccactccatggccaggctgccccatggagttggtccgcatccttttggggttggctgtgaggcccactctcttccctgcctattgcctcaaagcaggcattgtaccagatggtgcagagccctcacttggagacatccacagctgagttcaagtcccagtaggtcacttcgtggctgtctcaccataaaaacataatttaaaaagagtagcatgggtttccagttatgacccagccatgaagtcagctaatatatggtgcaggggcagagaggtggctcctggtcaggccatcaaggtaggttctccactctaccacttactggtgatgcgatcctggtgccccgcagactccctttacccatatgtggaacgggacacttacactctcttctgcagagggtggctgtgagttatacccaagctaatgtctatgggtaggtgaatgagcctgcctgttcccaatggggcctgtcttgtgatttctccagccttaccccttggggtgaccctgttcttccctgtcctctttccgttaacctttgtgcctctactccctcagtccccagcaggcagtggttctgggctgacaggtcgtgtggggtagcgggcttcacgtctctgaacctcagcttcctccttggtaaaaggggtgacgacacccaccactggggtggaggggcgagaagagagaatgcaacaggagcagcgcagggatcgtaccaggttctccaccgtgcgcaggcagtgggtgcagtggctgtggccgttgaagtccgacaggtcagcggccgcgtacccgtcgcggtcgcggacttccagctccgcgccgttcactaccaggatctggcagcactgtgggggcacgcagtgaggacccggccgcggccacgagctgggacccccgcgcccgggcagggccgtgcggagagcgcggtgccagcagagggcgcgcgcccccaccccgggcccgcgctgacctctagctccccgttctcggcggcgtcgtacagcgcggtcccgccccacaggtcagccgagatctccccgccgtgcagcagcagccagctgagcaccttgctgtggccgcggctcgccgcgaagtgcgtggcggtggcgccgtctttgtcctgctccgacaggctcacgtcggtgcagctcacctgggcgggaggggcggggagagagggccgggggatgggggccaggcccctgcaggccccgcccacggtcctccgccccactcctgatggccccgctccctccactccccgccctgccggctccgccccgtctcccctccgcaccgcccgggcccggagctcaccaaccacacgatgaccgggctgtggcccatctgcgccgcggcgtgcagtggggtcatgccgtcgtgggcgcgcgcgtgcgggtccgcgccgcattcctgcaccaggtactgcgtcacctccaggtggccctcctggcacgccaggtacaggggcgtggcaccgttcttggtttgggcattcactcccctgcggagacacagcgcccaccgtgggctttcagcgcctcaccccctccgaggcctccttacccgcccccctcccctcccggggagccctggacggcagggagagtgggcgggagagggccctgtcaccggcccgctgccgcccggggggctccgcctggactgagtcctgagccaccctccctcagaggcccctgagggcgtcccacccagcactgccctgccctcagtcccacttttttttttttttttttttttttgagaagaagtctagctctgtcgcccaggctggagtgcagtggctggatcttggctcactgcaatctctgcctcccgggttcaagcgattcttctgcttcagcctcctgagtagctgggattacaggcatgcgccaccacgccccgctaatcttttgtatttttagtagagacggggtttcaccatgttgaccaggctggtctcgaacttctgaccttgtgatccgcccgcctcggcctcccaaagtgctgggattacagagccaccgcgcccagcctcagtcccactttttaaccgaggtctacaaagatgtggtgagctggcctttcctcccctctcgcccactgtcaccatgagtccccacaactgctgtgtctgacctctatccctttcatcgtgtgccccctccatctggaatgtccttccatcctcctccctcttgaagactcagtacccatccctcctccatgagggccaccctgatttatttcccccttgctggcctccgccccacactgcccagggccactatgagcatgacctgtcatgcttggttgaccataactgattttgacctttgcctcccccagaagactgagttcccagcgggcagggtggtaagggttgccagacaaaatgcagttcacacagttcaaccggaatttcggatgaacggataatgctttagtattctatatcccaaatattgcatgggacatacttatactaaaatacaacttttttatctgagattcaaagctagtcaaacatcccgggttttgttgttgctgtttttgttaatctggcagccctcgggatgtccactatgtactgaatgcttctgctgtgctagctctgggctacggcactggcaagcaggttcttctttttttatttttatttttgagacggagtctttctctgtcatccaggctggaatgcaatggcgcaatctcagctcactgcaccctctgcctcctgggttcaagccattctcctgcctgagcctcccaaacagctgggactacaggcatgtgccaccacgcctggctaattttcgtatttttagcagaaacccagttttgccatcttggccaggctggtctcaaactcctgagctcaagtgatccgcctgtctcggcctcccaaagtgctgggattacaggtgtgagccactgcgcccggccatcaactattactgtgaccatcaactgagattacaccggtaaggcacctagcaggggacctgccagaatcagaattcagtcaatggtgcagctacagctggggaggctcacaggtggggctgggactctgtgccatcacccatagtcccacaacagaggcacagactcagctctctcctcggtcacacagttggtaagtggcacttgaacacccatctgtctgtgcatgcagggcctggctggcaatatgggcatgcagggagtgaagagatggaatgtgtctcaggggctcctcctagggcctagttttcggctgtcactgtcccttatccttgctctgccagcccagagggggcctacctagggaacagcagggctgtcctggctgctgggctgttgggtgtgaacagcccagggtgcagttgccaccaaaggacactaggtggagccacaacctacccccagacccaggagaagttccaggttgggggccacgacctattgggttccagttcaccttttgtgcctaggaggccaattcctcacaggacttgacatcctgcccatctacctcccccagtctttcaccccgtagatcaaccacatgctccaccctgcattcatccctcgttcacccatccaactgcccatccacttgttgcctgcccatcaacgtgcaccaggctacccccctttgcccacccaccctcttgttcccaacacgactcagcccctcttctgacccctgtcacgtgtgccctctccctccctctcacacacatcctgagcccctcccagctggcatctccctgtccctaaagccctggttctctgtccacttccctgactcctgagaccccaaggctgactctgactgagacccctgactctgcagcccccatggacccccactcactgatttctcctccctccccactccctagacacagggctgccatttgctggggctgatgctgagccgggcacttcatgatggtgcggggagcaggcaccatgcctggtgatccagagggggtcccgtcaacacagatgagggagacagaagacccagctacgtatctatcttcagaaacatgctggctcgtggctgccagcctccacaccccagcgccagcgtcacccccacacacactcacatactgctgcatcagaacaggctgttgaatatttcatgaccgacgctcagcggcctaaattattcaccccgtaaccaaggcacagtgagtgccggggtctttgggatcaggggctggtgggggcccactgggttctttctgcagaggcccacggcggtgtacacagcgggtggggggccagacctgcagtgagctctgctctctcagcactccctacttggcagagatccatgacccaggggtgcccagccagccagagaaggtctgagaagctggcatcaagcaggatctgagcagcagggggaagtggtacccacggcctcctgcagggccgctggctggcactcccagcccaagttcctggcacggaatgagccctcagtaagtgctggagctcatcaccattctcattagtattccaccatctgcactcatgcgccccattatggagtcagagcctccagcttggaataccccagaacatgaggcagatatgctgttgggctgggtgggaaggggtcctggctcaacatccccttccaccttggcctgaggacaagaagaacaatgggcactctcacagtcactggggagtattacaaagatatggatgagcataaggaccaaaatgaaattcccatcacacacctggaatccaagcacctcgggaggccaaagcaggaggactgcctgagcctaggagttcgagaccagcctgggcaacatagagagacctccgtctctacaaacaatacaaaaatgagccaggtgtgttggtgcacacctgtagtcccagccactcaggaggctgaggagggaggatcacttgagtccaagaagttgaggctgcagggaactatgatcataccgctgcactccagcctgggtgtcagagcaagagcctatctctaaaataaataaataaatgagaaaataaacaaaattcccatcactagagagaggaattaataaaagtaataatagtaaataataataatagtgatagcagccaccatttactgaatgattactctgtctcaagcactgtgatgagtacaacacacacgttctctcagctggtctttgtaacaaccccacaggacaggtgttagcattgttcttctggtacagatgaggaaactgaggcacagagagctaagatcactctgtgagaaagaggcagagccccgatttgaggctgtgtctgatgcagagcctgcttctgactccaaatgtgccacgtctacaccccttctgctcttggtcggtctgtccctctgcctccctccctccctcccactgcacagaccactgcccttccccacagacctcactgctgggaactcaggaacactctttgacagctgctggggcacagccccgcaggaggacctggctcgagtcccgtgcctttgagctgtgccacagtcttgcttcttgtctctttgtgttcccaaacccatccatgaaatgggggcaacagttgtcatcctgacctcgtgcagagtgcctgagaagtgcctgcagagccctgagcacaggcctggtgcctggcgcacagccattgctgaactttaggatccttccctgtgcctgggaggaccagccaccaggggggtctatggctggcctggcctgtccgggtcctgccaagtacgggccaggctgggcatcatttctgctgtggggaacactacctagaggggagaggatgggtcttgggggagacctctgactcccagacccttgccagctctagccctgaccacagtgacagctgcagaaaagtgctcccagaccaagcccttgccctttgccccggctttgacccaaaccctctttgtaggtcagaggcgccctggcgatgatcgtataaatcatgatttgttttctttctcctgggaacaaagatgctatggatgaactgtaactattcatcaagtcacctctgattacacaaaagaaacatgggtcccccgtgtgggctgtgggaatctctggcggagactggtgccagctgactgccagcaccgccgcagggagtgagctgcccatggagccagagtcgggctgcagaatgattcccgcagcccgccccactgccagtcacgcctccccagagggaggccaggaagaggctgtccctccgaggatcagtctggttgtggcccgtgactgctttcaattgaaattcacggagcctttggtggatctacggctctcggtgtcctccagtcaaacttcccggcctatgttaaaagattcccaagtaggcctggcccagggaagaaatgcagccccgatttgagaaaggttctacaccccagcccatcagctagcatggaatagttccagaagcctacagttgcctgcaactctcccagcctcccaggtcttcctcctggcccgtaattaggccaaatttgaccccccctgaggcctctacacctccccacatcactgccagttccaccatggcagggctgcgaggccgaccctcttttcattaggttctcagctctcctcccctcaaagatgcctggcttccctgacccctcaacttaaagaaccatccccatcgcttcctaccaaactcctcatttcactatatagcacttgccactcctgaattatcttgttctcctattcctcagacccatacatgcgtggatagaagaatgtgtggctgacgtgatgacaggccgggcagttgagtgcacccacttgctgtttgttgaatgaataaatatgagaagggacatccaggccaggagtaggggatgtctcttcactcatggccgcagcctggtagagcaggttagatccacttgccagataggctcggaaatgcccagaggggagttttgtctagggtcacatgcaatgagctgtaggcagagtggacaagtccctgggattccatgccccactcattcagcagatgtttactggagtcaggctctgggcatacagagccgggaagacaaagcccctggccttattagtcacggacagacgggatgaaaacacacatctgtctgtgtgatgcagggcccagccagaaatccgggcatgcagggagtgaagagatggaatgtgtctcaggggcttctcctaggggttagcttccggctgtcacgcaggatgcacacagaacgcaaagccaggcaaccatagggcggctgggaggccaggtgcagtggctcatgcctgtaatcccagcactttgggaggccgaggtgggcggatcacctgagttcaggagttcgagaccagcctggccaacatggtgaaaccccatctctactaataatacaaaaattagccaggtgtggtgccatatgcacctataatcctggctactcaggaggctaaggcaggagaatcacctgaacctgggaggtggaggttacagagagctgtgccactgcactcaagcctgggcaatagagcaagagtcgagtctcaaggaaaagggcagcagggaacaaggtcagcgggaaagtgagtgggcatcatgggcgcgggtgacaatttcagcgaggctcagggttggccttgctgaggtgaggtctgggcaaagacttgcaggaaggcagggagcaggcggggatctctgatccctgcagagggatcagcctctgtgaaggcaggggtgctggcctgttggaggggaccacagcccggaggagggacagcctctgggccattgtaaggaagtgagcagcattccctgtcagtggccagaagcctgtgacgggaggtgctcttttttttttgtgaaacggagtcttgctctgttgcccaggctggaatgcagtggcacaatctcagctcactgtaaccgctgcctcccaggttcaagtgattcttatgcctcagcctcccaagcagctgggactacaggcgggagccaccacacccggctaactatttttccccctgagatggagtcttgctctgtcgcccaggcttgagtgcagtggcgcaatcttggttcactgcaacctccgccttccgggttcaagcaattctcctgcctcagcctcctgagtagcgggattacagacacccaccaccatgcccagctaatttttgtattttttagtagagacggggtttcaccgtattggccaagctggtctcaagttcctgaccttgtgatccgcccgcctcagcttcccaaagtgctgggattacaggcatgaaccactgcaccagaccaggacttgcattgtcttttcttttcttttctttttcttttttgagacggagtcttgctctgtcgcccaggctggagtacagtggctcgatcttggctcactgcaagctccgcctcccgggttccagcaattctcctgcctcagcctcccgagttgctgggactacaggcacgtgccaccacacccggctaatttttgtattttttagtagagacggggtttctccatgttggccaggctggtctcgaactcctgacctcgtgttccgcccgcctcagcctcccaaagtgctgggattacaggtgtgagccaccacacccagcaggacttgtgttttcaaaggctgcgggtggacatggacgggtgaaggccagggcctttcaggcttactgaggacttccccttttccgttctgtagtgcacagcctcacagagccttgggcccagctgagcccaaggggttcaggtagcccccacgtgaggcagaaagggggtttctcagaagccctgggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctgtggcagaatcagggaccaccccaggcagagcctccagccttctaagggggagagttgagccctgggccctggggctctctaagctgagagttgctaggggcttcccaacaaactccctttctgtcccaggtgggggctgcctgaacccctgggccgtgggagcagccagactccgtgaagctttgcacaaaggaagggaaaaggggaagtctgcagtggacttgaaaggccctgagtgattaggacctggaccaggagtgggagagagacccagagaggaggtacagcctgctcaaggccacacagcaagccagtgatgaccacagctggtgaatcagcctctctaaaacaccatttctgtacctgtcagctccaccaggcagggacgcttgtctggttcaccagcatatcactggcatttagaatattgcctggcacatagaagatgctcaataaacattagttgaatgagtccatctgtaaaatgggctgattacatagctactgctcggggtggttgtgtgactcagatgacactgggtggtgccagacccctagaagatactcagcaccaggttctttttttctttcctttcttttctttccttcctttctttcattcgttccttttttttttttttttttttttggacagagtcttgctctgttgcccaggctggaatgcaatagcatgatctgggctcactgcaacctccgcctccctggttcaagcgattctcctgcctcagcctccctagtagctgggattacaagcatgtgccacctgtacaggcatagcccagccacacacccagctaatttttgtatttttggtagagacggggtttcaccatgttggtcaggctggtcttgaactcttgacctcaggtgatccacctgcctcagcctcccaaagtgctgggattacaggcgtgagccaccatacccagccccaggtactttccaatcccattccagtctagtctggtcaggggtaggggaggctttgggggaaggaggcacctgctgaagttgataacatctctgggctaactggttttccagcttgctgtgactggcagcacccacgagcccaggggaagagactggagcctcctcactccccagcctggaagctcaagcctcagggtcccagctgatccccagctccccgacccacacagccctgtccagctgctcaggccctgggacagccagaagcaggtgtgaggggggcagagtgagctcctgggccccaggaccctcctgggagggtggccactggccttggggccacctgctcttcgcccctcctcactctgccctgaatgggggtctggaccccttgttcccctccatcagccactggagctcctgctgggagggccaaccctcccaactcaatctccctgagacccagagcctgggacttgcccagcccagctcctgccagccccgtacctcccaactgagaggtcctttttctttttcttttttttccccacctggagatggagtttcactcttgttgcccaggttgtagtgcaatggcgcgatcttggctcactgcaacctccgtctgccgggttcaagcgattctcctgcctcagcctcctgagtggctgggattacaggcacgcgccaccacacccggctaattttgtatgagagatcccttttctacaagggctcagagggagggtcccacgtggcagcagccccgaggtcactgtgacaagtcctctgcttctgggaagacttggccccatgaacgggatagacagggaggtgtgggggatgtgcaggacattcctgcaatctcaagcactttctattataacaccccaaggtgtagccctggaattagctgagcctccccgaggctgtccagccttccagctcctctgcagcgtgtcacttccatgtctcatggccacccacagcccctccctgggcaggatcgagtttcccaccagcaggtccgggagcccttcctccctcagcactcacccacgcgccagcgagagagctgagccttgtgaataattcacagcaattcacagcaggccccagaggctcgcaagatcatgaagctgggccacctgggtgccctgattgggccctgtggcctggggcagctcaagcctctgccctacccagctcccagccttcatatccacagcctcggtgagcaggaatccctacccgcaagataggaggttaagtgggtaccccagcccccaaccccaattcccagctgctcttcctgcataagcccagcctggcaaccacagaaagacaccttcttatcagtcgagtcacatgctgctgtggggaacggagcccaagccctctgtccacctccctgagattcatggtgactcctggggggctggcagctcatcagtccaggccatctggccactgggtcggcaccagcgcccaatcacacacagcacctggcatggcctgggagggggtcagggttccccagccccggagccctggagggcgttccacagcacagccagtcttcctaacacctgggatccagcccacggagggatcgtggcttctcagtgaggaaggcttaggggccggcggtccccaccagcacttgcataaggcgggctcagcgtcttccagttcacacttgggccatattggtcccgccatcaggggcacctgcccctctcaagacctgtccttctcctctgcttgaagtgagggggtgggacaggtgcatcagaatcaccgccatgagggtggggacatgtcccaggtgtggctcccaggccccaacctggagagtctaactcaggaatctgggacagcctccaagaggtgttgacaggagccagttggaaccctctactcaagggtccctgggtccctcctagtctaaatcccactgactttgacatgatccaaaccctagtttgtttggaagtagtgaattcataccaaagcagccaccaagaaggcctggcagggctggttgtgaagcaccccttcctccgggtgctgcctgttgggtctcccactaaccaaaccagggagccccttcttagcaaggatggaaccaggcccagctcccttgtcctgggctgaggggaccactggagcccggcctggtgggtcctagggccaccctacatccacgccagtgtgcctgggcccaagaggctgcagctgtggctaccttgccacatggccatatggccagaactggcctccagcttgctccctggtggccaggggccctgcaggcacacccagaaactgaccagtggtggggacaggccagaccctctcacctcgtagctgctctcgtcctgaggctgggtccacattcacatttccatctcaggctcccacttagactaacgagggtcacccatcagagtaacccactccccgctcagacccctgtggcatctggcaccctaccctctcagacagggcctgggcagcttttcccaggatccctgcctccccaggcgcacctaagacctgagtctcttcctccctccccaagactcacacatgccacctgctctgttcgaccccccaccccacccgggggagctcccagaccactccccaggaggtttgggatccccatgcttcccttgatagtgggaatgggctgaggggccacaggagataacaagttgctttctggatggcctccagccaggggctctggggtcaggaggtggggtgggggttggggaggggcctttctcccttaactgcttggtaactaatggggttccctttctgcctgtttgactagggcctaggaggcgctcctgcccttgctgcccccaactccattctgaacagtcttgcaaatgagcacagcctgagccagagagagcccctgcggcagaagcagcccaaggggaacaggtgaccttggcctgtgtgcccagcctcccaggtccagctgcgtgcggccgggcagctgaggatgttgggagcacctgcttgcagggctctgggggcagccccagaaggggttttccaggaggggaagatttcatgttgagtgggagccatttctctggcctggccctctggccccaggatggctactggagggatcattgccctggagtgccagagaagtgtggaaaatcccaggcatcccccaaagccctggcccggcccacccagaggaccccttaagaggagtgatcttactcagggtagtgcctgacgagaagcctcagggaggggaagtctcctttggctgcagcgtagtggataggcagggcgcccatgtctgtggccgcggtgggatccccaccgccatgatgcaagagccagttcaccaccttggggtggccaaagcgggcagtcagatgcaagactgtgggaccagaattgtctttgtcctgtgggaggagagcgggttcaagtcctaaagcctgttgctgccccgcccctggcttgggccgctcccagactcccacaggcctggaaggtagctctgtgctctctgtcttccctggaagaattggccaggcctcactcagcagtggtttttttgggtcaagcggatcctgggtttgaatcctgcttctgtccttgggcaactaattggccctctctgaaccgtacgtagccaataggcagcaccgtgcagggttttcagaggctgcaggtcctgactgcgagctgcctacacgacaggcacctggttgtcatggcaggagactggctccaggcccagggccacagccctgactcccaggggctcagggaatgcctgaaggagtgacacagggttactgggctgagcagggccaggaagggtggctgtggggctgtaccaagctagcatcaggattggggggcagcccctgcatccaacacttgccccctctctctccacccttcctaggtgtcacgtgggaacagagacctccaccttggtgcgcctccagcaacccaacctcagtgccttagtcaggcaataagggccctggggactggtttgggtaggaaggacacaccaaatgagcaggaggaatttccccatagaggcgaagagaatccagagatggtgagggagaaaagcacataagaaattaaaaacaaatgcaaacaaacaaggttgaaacagggctggagggtgtgaatgtggtgattcttctcttcctgaggagacagggtcctgcgagttttgtcacaagtcaggaagctccatcagctctgcaacacctgagtcctggatggcgggagatgatggcttaagatatctgggcgcaaagcctgaggccctgcctgtaactccgactccctcaagggcagctgagagggaggactcagggcactggggaaagtcagcagacccagtcacagaattagaataaggtggagctacgcagggaagacaacaccaactatttcctttttcttattttattttattttatttatttattttttttgagatggagtctcgctctgtcgcccaggctggagtgaagtggtgcgatctcggctcactgcaagctccacctcctgggttcacgcctttctcctgcctcagcctcccgagtggctgggactacaggcacctgccaccgcgcctggataatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaatgggaacttgttcacttttagactttgttattgttcattttgggcttatctttggtcttttcctgtgctcttaaaagggtgcaaatcaaaatctgagttatgataatccacttatcatatgactaattacttcagtacaaggagttcctgcctgtctgtccaatatgaatcttactacgtcccaatgtcacattggcttcttttccttctcggtggcagcatttggagcttttacttaacttagggtcaatttcgacctctgaattttccacccctcccccacagctgttgctgggtcatgctgttttcttttatctctataaatattgtgacttgtaattgtcacttataaattcattctggctatactgaatcattcccccattatccaagtcatccaaatattcgatgtgcatttccacaaatcatgtagtggccccctgattggggatgatttgtagaattaattatatgctttagatctccattcaggtcttcaggtcaccaatacattaagcagagcagggccctgaacagcttatatggatcaacgattgacagagctgtcggggttgctgcaaagccactgactttttgctgttccccgtaacaaagtatgttcaaatctaggtcacaggtttgtggtagggtcgattcacagtatacatgtgcaacggcgttcagtagcatagcagttgaggttgtgaagacatgtgcacccaggtcaaagaagaaagatccttagacaaagccgctcaattcccaggcacccaatcttccttgggctttgtgaacctgagatttgacaggctcttgggaatgtctgtctctaagactctgttggcaggcttaatcaggctggtggccatctccatatgtgcccccccagcatttgtgacaaaataagggaagggggacccaataaagctacttctgaaagcttatgatcccacccctcatttaaactatgtgatgttgtcattctatataaactctttccaagtaacttaactaaaacacactttgccattagtcttgagtgtgggcacagcattattcttttctaggccttaagggttccttctgcttaaaaataatgtctaactttcatgaagtttacccatgattaaagtgccttctgaatatatattatcttgttctattggtttcaatatacctattttctttaaaaagaaaaaaatgatgaaccatgagtgttaacaccagaaaaaccttaaggtacatctgatctaatttcccactttaaagtgagaaaatcaaacagtgcctaggggtttgatttttccccaggctaattcgggttttcatatttccatctcaaagtggactttctttggctaactttaagttttaaacgtaaaggcctgaaaagtaactcaggatctagctttttcattagttttgatcgtgtatgaaagcaaatatttctttcccccaaatgaaaccccagggcttccagtatttgtagtgatagtgtgaatccattaggtctatttttaattatatctctcttattggttatttttttcacatttcctaactcatttgtgatattgcttccatataattcaactttttgtgcgctgggttcccatttgccccacaaaggcctatgtgcaaatctgatatcctgtttgaatgacattgttttgtttttaccttattgcttcctatctttcacaacaatgttgtcagttctcaacattaaggcattaaaaattagcttttctcaaatgctcagcatcattaatcattagggaaatgcaaattaaaaccataatgaatatcatctcacacctgttagagtggcatttgtcaaaaaggtgaatgatgtgttagacataatgcagagaaaagggaacacacacattgtgaataggtatgtaaattagtacagctggtgtggaaaacagtatggagtttcctcaaaaaactaaaaatagaatctaccctatgatccaggaaccctatttctgggtacatatccaagagaagcttcagagagtgctttgttgggttttctggaacccggcagggctcaggtgtgtggggatgcgctctgtgagcctgtgtttcctccgccgtgagggctcctcccgctcctgtaggaaaaggcagtgcccattttgtcttgtccatgtgggactccaaagggtccagacgcgacagaaaggcggcgaatcctctcagagtgggcaggggaggagatgatagaatatggggaggagatagaatatgggaatggggcagtagaggggtgggatttcatgaaatttcctgattcaaggctatcatgaagtaggcctctttgggagctcggccctccagtcgctggtgagggtaacatcccaccagtctctggtgaggtccagtcgcctccgccgactgcattgaaagccaaaagcagaactaggccagcaccgcggcctggcgtccagtgacccagcggtctgcatattccccagggtggaagcactcggacttcaggtttgaaggcaatgcggtcaccactgcaataagaaaagcaactagggaaaatggcaccttcttctccaaacttttgagacactcttgctctgtcgtccaggctggagtgcagtggcacgatctcggctcactgcgacctctgcctcccgggttcaagcgattctcctgcctcggcctcccaagaagctaatttttggcatagagagagagaggggggaagggggggggagagagattgattttaatgtcttcaagcaaaaagagactctttctgcctgttggccatctgctgccaggtgaacgtgaaaatccatcgagacgctttctgtgaaaaccgcctttatctctttgtccctcttaggttaaaatccgcactccaaaaccttattgaacagaaaaattacaaaaagcacatataagacgtttcagttttgtaaagggtaaaatgaaactgcccttcaggaagaatcagaagaccgacgagggagagaggagcgatcgtgaaatctaagtgggctgcccccgggtcttccagggttttgtactcggtggcttggcctgagttgatgtgcccatattttcaaacagccaagtgccctgagacacagcctttgctacggtacctgctgaaatctggaagtgtgattaactattacttaaattgagtggggcagactaagagacagcagcagtgaaggatgccctttgggagaaagacgtcgaggcgctgaggccaaagggtccgtgaggaaagagcccgcagctcgcgcccctcggcctgcggaagggagggcaaggagggtcctacggttcctgggaggacgcgaagagccaagagctctgacagctggcgccggggaaaaggccccgaggcggggtccgcatccctggaagggcggcgtccacactcctgcgaggcacggggcgcccggggctcggaagctcaaagcccgccggcttctgcagcttctggagcttctgggagccaagagtgtcagccggaaggatcccgcacacggcgcttagttctggaactggatacccgggggaggatgcgggatcccgaagcccgggtgtgggtccccgtggtcttcgtgttgggggtaggtgcggaacgctaagcctgggcctactgggagccatagtcttcttgatggctggtgcttattgggcttttttcagtcgaatttcaaaatgcagttgaatttcttactttggaaacgataatagaaatggctgacctcagattttcatgattatgttttgccttttccagtgtatgtgcagtttctgtagtatagtggttatcatgtttgcctcacatgtgaaagacccttggctcgagactggagggaaacatggttttttggtttttctttttgtccctaaatttagtgagtttaatcgaggttgggaaacaaacagaaaagtagttgaacctgtggctacactttagacctcctcaatctagacagattgttgaccaggctacagtttccactggtctgccagcaagaggcctgcttaatgttagctttggttccagaaattccttaagattctcttcattctcttctgtcgcctgaattttcataggctgacactgaaagtggatgacatcttaatgcatttcctaagtgtcccgctgggcttcgctttactctgataagttgcagatctggctgatttgcgagacaaaaacaaaatatttttttaaaagattctaaatctgcatctggaacttgtagagtcaataatctgaaaccacacgaattatctacatacaaaagattttgaatgcataccccttccccaaataatcctcagaaaaccggttaagttttagcatctatgactctgagatgcatatgaggcctttgtaaatttagaagttgagagtagaaagtacaggtttgtattttagaaggagatttgggaataaatatagctctggtggatatagatcatatgttaaggtttgttggccagagctggtgtgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatgtggggaaaactctggatttgtctcttcagttgaatgtctccgttgaaaattgaggaaagaaatctctctactatttgaacttcatcaaaagactaatatgttaatattttgaccgtcaatatttccttaaactagtctactcctttcatagctaatacatcaaagcatattaacttaggaaatgggattctcccaaacaaggaaacattgacggcaagggttcttaatcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtggggaagaatctgcgtggagatgaggggagcggcggggactggtccttgcgcagaggtggccagtggaccctcagggctgtaccccagacaccgtgaaccgaatttgctcacatcgtcagcggccgcggcctccgcgtgctttgtgggcccatcggtgttctgcgagggattccgtgtgtctggcaatgtctgtcaacaggtgttggcctgaaatttggccgggcacgttggctcatgcctgtaatcccagcactgtgtgaggccgaggcggatggatcgcttgaggtcaagagttcaagaccagcctggctaacatggaaaaatcccgtctctactaaaaatacaaaaattagccgaatgtggtggcatgcacctgctattccggctacttgggaggctgaggcaggagaatcgcttgaacccaggaggcagaggttgcagtgagccaagattgcgctactgcactccacctgggcgacagagcgagactgcgtcaaaaaaaaaaaaaaaaagcagcgaaagaaggcagagatgtcaatgggacaaagagacctcccaggaggcttgttgtagaggcagtgggtggatcctgggagatgagatttttttaaaattatgtagcagaatggggagagaaacggagaagcgcatgaaagagagaaaagcacgaaaatcggcggcgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgccgcctctcaagggccctttgtctgtagcttccactggtgaaataatgcggttatagtctttttcggtagagaaaacggctgtatcagtggaattttttaaaaacacaaaacgagaacgagtttttaatgagctgacaataaaatctaaactagttgtcatggtctgcacaggcttgcctccattccccatctgctaatttttatgagaacagtaaattattactattatcattatttttgagacgtagtcttgttctgtcacccaggctggagtgccgtggctcaatctcggctcactgcaacctgtgtctccgaggttcaagcaatgagaacagtaaagaagctacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatatgttttgtgtctggcctttttctccagttacattcattatactcatgagatatatccacgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgctttttcgccagcgatgacagttgaagtggcaccaaattcttgtcagcatttggtgtactaactttgttaaatgtagctatgctctcagaccaggctggccaacatggcaaaaccctgtctctactcaaaatacaaaaattagctgggcatggtggcatgcacctgtagtcccagctactccggagggggatgttgcagtgagtcaagatcgcaccattgcactccagcttgcgtgacagaatgagaccctgtctcagaaaaaaaaaaaaagtagccatacactggtgagtggttagtgctatctcagtgtggaattaatttgtatttgcctaatgagcaatcctatgaagcatattttcttatggcttccagcatataagaaactctcctttgcaaaggcctattcgaatattttgccctattttatttggcttagctctatattactgacttacaaaagttctcttatatattcaagaattgagtcttgttttgacgttttttaaattatactttaagttttaaggtacatgtgcacaacgtgcaggtttgttacatatgtatacatgtgccatgttggtgtgctgcacccattaactcgtcatttacattaggtatatctcctgatgctatccctccccctccccccaccccacaacagtccccggtgtgtgatgttccccttcctgtgtccaagtgttctcattgttgaattcccacctatgagtgagaacatgcggtgtttggttttttgtccttgcgatagtttgctgagaatgatggtttccagcttcatccctgtccctacaaaggacatgaactcatcattttttatggttgcatagtattccatggtgtatatgtgccacattttcttaatccagtctatcattgtgggacatttgggttggttccaagtctatgctattgtgaatagtgccgcaataaacatacgtgtgcatgtgtctttatagcagcctgatttataatcctttgagtatatacccagtaatgggatggctgggtcaaatggtatttctagttctagatccctgaggaatcaccatactgacttccacaatggttgaactagtttacagtcccaccaacagtgtaaaagtgttcctatttctccacatcctccccaacacctgttgcttcctgactttttaatgatcaccattctaacaggtgtgagatggtatctcactgtggttttgatttgcatttccctgatggccactgatgatgaggattttttcatgtatcttttggctgcataaatgtcttcttttgagaagtgtctgttcatacccttcgcccacttgttgatggggttgtttgttcttttcttgtaaatttgtttgagttctttgtagattctgatgaaactacagatgagtagattgcaaaaattttctcccattctgtaggttgcctgttcactctaatgacagtttcttttgctgtgcagaagcccttaagtttaattagatcccatttgtcaattttggcttttgttgccattgctttcggtgttttagacatgaagtacttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcccgatagtgattcttcctacccatgagcgtggaatgttcttccatttgtttgtatcctgttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattctgtatgctgaggagtcatttttaaaataaatatattgcaaatgacttttcccagtcagtgaaaagtctgactgaaagctgtcaactgaaaaatcacacaatttataaatttagaagggagattttattttttataaatggttacagcctgcaaggtggccattctgacagacagggaggcataccctcttgctgctgaaacctgaaaagtacgtttccagggaggggaggggggaacagggatttatgttgatgtggtgggccacatatacatattcaacagggaataggaggagctctgaatattcatgaagggatcctgctgcatgcatgctgagtaaacatgcctgttacatgcaacccatgttcattttggggtggagacaacatttaaatacattataattaggccctatgcttcaaaaggggaagcagggacacaaaggcagtcaagtgcacagcctctgtaaaccgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggcgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagattccaactactgggcaggaactcagtagttaagacttctctggggtctccttggccaagaaacagtctgtccagttggttgagtggctttggattttaattttagttctcaaagcatttaatttgatgaaattttgccatattttttctttatttttaaagcctgttatgttctataagaaatctttctactcaggatagtgaatgtattctcttaattttatctctctatgagttccagcgttttagttttaatttttaaattgatgacatctaaaattctactcctaaccaaaacattcctgggggtgaccaaggacaactccaaaaatcttccataaatggaagtaagacttactccttgaagaacttactgggatctgggcctgcagggcacagtggctttagtgcacctctgctcttacgactattcagaaattgtctttgtgaacccatcaggctgtttcaaaatcagcaatttagggcttgcttgcaacatgcagttatgcagcagctgttttgtggatctggtgagtgcctgcacgcatagttccccgggaattttctgaatttgaattctcatggtatttcaagtggctcagttgtctctttcttttcttttcttttcttttcttttctttttttttttttgagtcagagtcttgctctgtcacccaggctggagtgcagtggctggagtgcagtggcgcgatctcagatcactgcaagctccgcctcccgggttcacgccattctcctgcctctgcctccccagtagctgggactacaggcacccgccaccacgcccggctacttttttgtatttttagtagagacgaggttttaccgtggtcttcatctgacctcgtgatccgcccgcctcggtctcccaaagtgttgggattacaggcgtgagccaccgcgcccggccagttgtctctttcttttgcctactgccacacacgtaccaccaaatcctgcactccaagctgcttctacaccctggactcccaacctccagttagacaatccacatcttcccacacctgcctcaggctccatcaggctactgtgcctcctgcagcaaccaggccagggggaatctggattcctattacacttctgaggaaggtggtcagggagtgtggaggatgtgggtgggagggggtgaggttgagggcaggagtacactgtggtcttctgtcttctacctcattggcccaggtgctgctctccctccggttgtctgctttcagccctgcctgggaaatcaggccggcgccctgatcttcctgactctcattttgtgaggaacctgaacggatgagccatcgctcttgtcccacacgttctgtccaaaaggtgccctcctctctgcttgctcgggggcctgccctctgagctctggcactcaggctgggatgccgcccagtacagaggctctgcagccctgcaggggtctgactgttccacaccagcaggataaaggccacagggcatgctgtggtggaaaagcattcagaggtgtgggctgaaggcctctctttccacagtccctttgaagacaccatggaagtaggcacccccttgacagacaaggtggcccaaggcctggcttcacatgcaggctcttgggtcccagcgggtcctctctgtgcctggtatagccaactgcttcacgcatcttacccggtttcctctcctccacaacccaagctcctcctcgacccccttgctcagctgtcctcaggacagcaagatccccagcccttggaaaagcccatctctagtgcttggggagggagttgggttcaggtggtctaaccacagaagaacagagaacctgaggcaggaggaaatcccttcccttgctgggtctcttggcacagcccatccaggggtctgggtcagggtccaggtatactctaccctccttgaggacctgggttttcaggcccccgaggttggtcaatgtggagtctttcccactgttcatctgggaactgaaggaatatcccatggggccctctcttactcattagagacacccagaaaatactccatccagcagaaactgggtgcagtgtaccagaccactataattataattgcaggatgtggaggtcagatacgttttgtgggtattttctctctgtctgtggcttgcttgccttttcgctttcttagtggtatcttttgatgagaaggtgtggctaatgttgatgaagtctcatttatcatgtctttcttatatatgtattttttctgtgtcctgcttgttggtaggctaatctttgcctgccaacaagtcacaaagtatccttgaaatgctttatatctttaacttttaagttttggtgtgtaatgcggctgaaattacttttgtgtgtaacgtgagggagaataacattgttggtctccccacatccatatagaagttcattaattgaaatgatttattttcttttattgaactgcttttactgaaaacccatttattgaccgtatagctgtggatcaatttcaggttttctaactcaggctgtttatccgtttgtcactcttgatgccttgtgtctaatagcttatagtaaaccttaaagtcagatagtacaagtccttgttcttttccacacattgcaataaattttgaaatagataataactcatgaaaccatcacacacatcaggatatgctgtcacttcatccctttctgacatggtttggccgtgccctcacccaaatctcaacttgaattgtatctcccagaattcccatgtgttgtgggagggacttaggaggaggtaattgaatcatgggggcgggtctttcctgtgctattctcctgatagccagtaagtctcactatctgatgggtttctcaggggtttctgctttggcttcttcctcattttctcttgctgctgccttgtaagaagtgccttttgcctcccgccatgattctgaggcctccccagtcatatggaaatgtaagtccaattaaacctctttttggtcctggactctgttatgtatttgtcagcagcatgaaaacggactaatacactctcatttctgagtgggacacatgctgtcactcacatatgctggttgctgacttgtgacggaagattctctattgtaccctctggggacaatacatctccagttgcctgcggggaggatgaaccctcaagagtcaatgtgttgactgactctaaatatgggttcctggtgctccatgctcatgcagccatagggaaggaaaggggactatcaagagccaagggatcccccatacgactttactcagatcttggaacttttagatgctgtccaactcccaaagaaataacaattactcactgcaggggacaccagaagggagacacttttattattagaggaaattccctggtggaaagagcagctaaggccacaactaaggaaaccctggtatttcaagctgctgcgctactaccaggtactgcatccgtgtcagtgacaccatactatacccctaaggaaattaaagggactgagtaaaaggcttccagggagacccctctggatggttgctacaaaagaacaaactctattcctgaggctgacagatgggaaataattaaacattttcatgattcctcacatttgggacgggattttccattcaaattagtttcctaaatattcttcgggaagggactgttctaaactataaaaagggttaccactcaggaagccaccccataccccgatccctgcttaaacctgtacaacaccaaggaacataccatggtgaagactggcagacagacttaacccagatgccaccttacagggaactacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctgtcttcattcctcatggagatctcagtcttcaaataacatagaaagccaatcgcgacattagcaaaactctttcagtttgggggcttgcctgccctgcgtcactatcattgtttccttgggtttcccaggaatgtacatgtgtgagactgccgccctgcttatagatctgtttccctgcaaggaaacaggaatatgttgcctgtggcttccagagttggagatacatgtagttgcaccactgagggctaacatttaattttggaatcaagtgatgcattcagactggttgctatcattctgtggtatatatttagtgaacacattcatgattgagtttcttgcttttagctggagcaagaaagttttataattgtgatttgtatgaaaaaatcataggcaagggaatggatgtaaaataaactttattgtcagaggtttctaaaggctcatccttcaaggaaaatggacatatgctgaagagctgataaactgtctacagcagtgttattctaacctaatcttgattccaagttcttgccattttcctccagctactgttgactccagttatatataggatgggggaaaggggattatctacgaatgtaggcatcactttctcttgggcagttatcacattggcagactgaagggaagtgatttctacaatcaaactatccatttggagtacaaatctggagtggctgtaaaattcggttctcagagatgaacttgcagattcggactttcaattgttctgttgttttagtttttctcatcaactggggaactgtttgtgactaagctttgttaaaagtagagaagagcttttcataattccaacattagttgttacctgaaacaaacaaaaacacacacagagacaattaaacagtaatctttggtgaggtcttgctgatacctgaggctggagtgagagctgagtggtgatacagctcatgtgcgtgatccagattgcgcactccttatgagactgtaactgatgcctgatgacctgaagtggaacagtttcatatggaaaacatccaccacccccttccatggaaaaattgtcttccatgaaaccagtccctggtgacaaaaaggttgaggacagccaaaaaggctgctttaaatgataaccttccccaaaactaaattacccctgtaaaatgaatgaaaggccaccaagttagaaggatgaaaggggcctgatttctactaagatgtatgcctcgttaaataattaccagccattattccagaagtcacaagattggcagcttccccaattactgctgtgaagaacatcactattgtagaacctaagattggcctcttgagatgtcttttcaggcttttgcatttctgactgctggaaggcaccatctggcccgaaaatcaaccagtcccttagcccccacccagaagctgactccatgcaggagggccattttccacgcccctgtgatttcatccccaacaatcagcaccacgcaagccctagccccctccccaccaaactatctttgaaaaaccccttacctccaagccttcagtgagattgctttgagtaataactctgtctcccacatgtcgtggctggcctgtgtcaatgaaaccgtttcctgcagtgccatggtctccatgaattgagtttttgtgtacattggtcaggaagaacccatcaggcggttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatattttgccatgcttccagtggcctaactggccaccatgccacagaatctttactttatgatctccaaggagaactctccactcgatgttttgtgatttgagcaatggaatagaatctgatactggtgggctgggggaggtccctggacactggtgggatctcgaccccagccgtggtgtccaggctcttgacaccatcgtgagaacaaagtcaaagatgagtcagcagatagtgaaagaagagatttattgcaaagcaaaaagtacacactcaagaaaggggagcttgggcatacccaagagagaataatgggttctggggtttcatcttgatgggtttctttaaccaagaattggaatattcacgaaaattcctgggtaaaggtggagatttcttggaactgtggtgccatttttacatcaaacactggtctcagaactgtcatggcactggcgggtgtgtgatttagtatgttaatgagcatataatgagggcctaggtaaaacctccatccaatccagcaccacgttgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacatttgttaaacatctcaaataagatgtagcccaggtatttgtgtcaaatttggattattttggtttcgtctttgcagaatataaaaaactaacatgaggtaagcactaaggtgtggagatggctgtgcaagagatgacaaagtccagcaccacgcttgagagtgtccaatcatctcttctgggacagcatatttttctacaatacggatttttgaaaaaaaaaacaacatcaaaaaaaaaaaaacctacaagattcatgaaactggacaactgtctttataacattaccagtgataaaaccagtaaggacggctggtttgcagtcatctaagcagcctctttactttcataaatatggtttctctctgatattaaacggcttccaattgcaagcggaatgctgcatcacaaggataaggatgtgaagagaaccggtttcttttgtaatccgaaacattctagtctgcgaattaaaagccattatttgaagaaggatgccccggctccatctggccaccgaaaggttgctccttaacacaggctaaggaccagcttctttgggagagaacagacgcaggggcgggagggaaaaagggagaggcagacgtcacttccccttggcggctctggcagcagattggtcggttgagtggcagaaaggcagacggggactgggcaaggcactgtcggtgacatcacggacagggcgacttctatgtagatgaggcagcgcagaggctgctgcttcgccacttgctgcttcgccacgaaggagttcccgtgccctgggagcgggttcaggaccgcggatcggaagtgagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagaccgtacgccaagggtcatgtcttttttcgtattggtttgtgtcttagttgttaatcctacagtggaggcctggggaataagaagtaacatgtggcctgcacgccataggagaaaaagcgagcatcagccgtatcggctttgtaacacaaattagctatcgtgaagtccgctcagctcttccatttctaccctggctgctttttgcagggattggtccgtggtctccagtctcttgggttctcaccctgtgtgaaaatcttcgtgtttttccctaccccccaagtcacctcttacacagcctctgcttccaagcgcagcccccacaggagtttgtaggatttctgtgctagcggggagtgtgttctcacctcatagagccaggtagaaattatgcagatgggcgctgttctctgggaagaaagcagggcctttggggctctcagtgtccccgttgggttgtagacataacactcttactttgcgtaggggaacggctctgccggcccccaggtgccctagcgcatatgcatggaggcccgcaggtcagaaccgcagtctcacctgtcttggcggaaatgccctgcgatcctcccggagatagaaggcgggaagttttatgaggagccggtccagtttccctactatctcctgcagttcatatatctagtgtttctttagactttaagcgactgcttcatgtttgatgtctcactcccacatcctacatccactgccagccaactttatagatagcaccgtgacccatccttcccacccccaagaagccctttcctatttctggtgccagtgtcctccccagtccctctttcttcaggccctcgcttatcaccttcatggacagaaaatacttagctctctctcaacctgaggtttacacctgacacgcatcagtgccctggcaaattccttaataccccttctcaaatggcactgtaaatcatctctttttaactcccagaactatctaattggttttgtccctgcactacatgaacactagtattccactacagaggaaaaccccaggcctagcgatagcggttctgggcattgtgccagcctctcccagggtatgttttctgacctcacctacttttgatcagctgaggtcaggagttcaagaccagcctgaccaacatggcaaaactccgtctctactaaaaacacatacacacgcacaataataataataatgataataataataattgccgggcgcagtggtgtgtgtctgtaatcccaactactcgggaggctgaggcaggagaatcgcttgaacccgggaggtggaggttactgtgagccgagatcgcgccattgcaccgcagcctgggcaacagagtaagactctgtctcaaaaagagaaaaaaaattagtgcatctgagacatattattggagacagtagaatcctgcgtccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctctttctctctcattctttgcatcattattttttgccatcagtgtgggtttttggttttgaggttatgaagtgaatttctggggacaatctctgttgggtcgtgttaacaaggatccagtccctgtttggtgatacatgacagctaatctggtctgtgagtcttctttattgtctatttattgtcctgagaataatggcatttcctgatatttgagactgcagcaatgataagttgttcagatcttgtctttccaatgtttggtaaacattttataggcccaatttttgtcaatatctgcaagagtggcatctctgttacaagagtgatcttactactcgatgtcccccctcccacccaacttcatttcctaggggctcttggctttaacgaatttactgtatctaaaagacatcttagtacaggaagaaaactaaatctgtagcatgtaaggagcagttttatttgattggtatattcaggtttctaaccagctgaaaaattcaaatacatgccctttaaggattaagtttaaaccacactacagaaagagaaaagatttatatgatcacatataagcaatggaatcagcaatatgagtacttttcacaactatacaaatcaaatttaataatctccagaacattaaggaagttcagcccttaatggaaatgaatgaaaagaaattattcacccactgttacatgccctggaaagagaatgtcctgccagactcaaaagagtatcacaatattactcagattttcagcaatgaaggccctccgaggatctaatgatgttcatattttcagtttatttccttcactgataaacattgttaatagataccattgcctctgtttgcactttaagtgatgttacttagaacaattcgtttctttagcatgcaccctagtttggtggaaggaattttccttcttttcaaatataggatattttctcatgaaacaaattggcatactctttcagtgaagtgaatagacaaattagatctctacaattgtaaaggagtcactgccccaattatcttaggaacaataataatcacttatataaaattaaaataagaaaattaagccaggtatggtggctcatagctacagtcccagcactttaagagttggagaccagcctgggcaacacagtgaaacccctgtctctacaaatttttaagtattagctaattttttaaagttggccgggcatgataatgcatgactgtaatctcaggctgcagtgaactatgattgtgccactgccctccagcctgagtgacagaatgagactcccaactcaaaaaaaaaaaaaaggaaagaaaattaagaatttgttgaaaattgttttactacaatgctaggctgcatgtcttgcacctgtactcccagcaactcaacaggctgaggcggaaggattgctttaggccagcagttggagaccagcctggggaacagggcatgacatcatctctaaaaaaatacaaggcaagctgagccaggaggattgcctgagcccagaagttccaagttggtcagctatgattgccccactgcactctagcctggataacagagcaagaccctgtgccttatttttaaatttatgttatttttttactacttatgcttatttatctatttatttatttttgagacagagtcttgctctgtagcccaggctagagtgcagtggtgccatctcagctcactgcaagctctgcctcccaggttgaagctatttccctgcctcagcctccagagtagctgggattataggcacacgccaccacgcccagctaatttttatatgtttagtagagacagggtttcatcatgtttgccaggctagtctcaaactcctgacctcaagtgatacacctgtctcggcctcccaaagtgctgggattacaggtgtgagccaactcgcccaggctccttatgcttgaaatgtgaggtttcattagggaaaaattttcttgttgaatttctaacatgaaaaaataatagatttagctgtagattaaattaatggtcctggtagtttggtacaataaaataaatgaagttgatagcagagaggaatctttgatgcttttgaacaatttaaataatgtaatattttttatataaagacatgaaaaagttcattacattattattatatttatttatttatttatttattttgagatgtagtctcactctgtcgcctaagctagagtgcagtggtgcaatctcggctcactgcaaccactgcttcccgggttcaagcaattctcctgtctcagcctcctgagtagctgggattacaggcacacaccaccacacttggctaatttttgtatttttagtagacacggggtttcaccatgttggtcaggctgtcttgaactcctgacctcatgatcctcctgctatggcttcccaaagcgctggggttacaggcataggccactgcacctggcccattacattattttttaaaaatcagtgtgactcttttgacaaattagaatggtttaataatcttggttaggctgggcatggtggctcatgcctgtagtccaagcactttgggagcccgaggtcaggagtttgagaccagcctggccaacatggtgaaaccctgtctctactaaaaatacaaaaattagccgggcatggtggggggctcctgtaatcccagctactcagaaggctgaggcaggagaattgcttgaactcaggaggcagaggtcgcagtgagccaagatcacgccattgcactccagcctgggggggcaacagagtgagactctgtctcaaaaaaatcataaataaataaaaataaagtataaaaaattaaaattacgtgttcaaatacattaaatatatggcaatgaaaaggaggcctagcatgactgactgcattttgctcctaacccttcctaccgtgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagaagtgtgacctgacaaaggaccaacaattttcaccatccccttgggctctcactgcagcccatgtctgtcattgtcagacctcttcacctcaatcgcctccttcttcctcccttccctaatgtacaaggagccggaaaatagtattaatttaagatggttcttcaggatgttacttcaccatctgttcagtttggtggctctctggaataaagtcaccttccctgcccctacacctcaactctcgacttattggctgtcatgcagcaagtggtgagtgcagtaagccgagatcacaccactgcactccagtctgggtgaccctgtctcaaaaaaaaaaaaaaaaaaaaaacagagagagagagagaaatttggtttttgaaccagacaaattaaataggagacttaattccaatgagacctagaaatgtctaaatttctaaaatttctaaaagaactgagaaaattgcctccattgaggaagtaagctgaaggaggtagactgtcatgttttctgatttgagaaatattgaggaggctttgtctctttcacctccaactgctccttctcctcctgcccctgcacctgcatagtctttcttacctgagccttcctgtcctgccttgcctcttcttccatcaccatcacctaaggaaagtccccagggatctggtcccttccctgaaacttctgttctgacagcccctttcaaggtaaaacccaaacccacaggaagaggggagcctaccgttgtgtataccacttcaccaaaacgtgaattaagaatattataaaggacttccctgatctaaacttaaatacatttcactcttctgtttctaaagcaggctccaagatcctgtaggctttggcagaaaatttgacttaactgttgaaacctttgagcccaaatattctgatctttatcaattaactcacatgctggtgaagaagggaaggccactaactggttgcaaaaggtaaattggaaggattttcaaaaagggactgaagcagaacatgaaaggttcacattttcaccaaatatctccaagttgccattccccaggtccttcctaaaaatatagattggaggataattcagcattgtactaaaaagccagacaaatctgtctttgcttaactaaaatggtttgagagccaggtgtggtagttcatgcctgtaatcccagcactttgggaggctgaggcgggtgaatcacttgaggtcaggagattgagaccagcctgccaacatggtgaaaccctgtctccactaaaaatacaaaaattagccaggtggctactcaggaggctgaagcaaaagaattgcttgaacccaggaggtggaggttgcagtgagctgagatcctgctactgcaatacagcctgggagacagagcgagactctgtctcacaaagaaaaaaataaaaagaaaaaagaaaaatagaaaaaaaaatagcagggtagtagaaatataatgcacacaagaatgataatcatgaagacaatctgattctacaagagtaagggaacctattccattagagagccaactgaaaacatcaaatcccagttcacaccccagggtgtggggtcacgtgcctgtaatcccagctactcgggaggattagtaaggaggtttgcttgaattcatgaggtcaaggcaggagtaaaccctgatcatgccactgcactccagcctgggtgacagtgagaccttgtctcaaaaacaaacaaacaaacaaacaaacaaaaacccacaaaaccaaacaacaacaaattgccacctcactctgaaatcacagtggcaaacatcactttgctattgacaaattaaaagaaaaacactccctcttgctatcaacctggcctcttgctctaacatgtctgacccatggtttaaaatgcccaaaagctgatgtcctcaaattataatacacttacctattctgcaccagcatttatttttgtctggaggagatcaccatccatggtcctgtaaatgtctaacagcatggaatgatgaagggcagtgtcttttaggatatttggttatatctatatatatggctctgaagaaacccaacactgggcgagttccctcaaacttttcactaggcatgaccactgctgtattttagatagagattctgtggggcaaaacctgagaattatctgcctggctatctagaagatagctccttgcattttttgggggagaacacttttgcttcaagggagtgtttcctcccaggattagaaatctttctgtaacctcaggaaacattgctgatgaaaaccaggcatggtgtgctgtacaacttgtagtaataaggcagaagttaaaaggaaaagacaggttccctgtacttggctgactccaagacctgccatagatagagccctagcagatcctcggtaacacgatctgaaaagtcagagccgcgaggagtgagttccggagactctctcaacacagtaagccccaacaaagataagaggaaaaaacaacaaatgcctttactaccttctctttcccccttcccatttctaattattcaagttttgttaagttcttgatttcccttcagtgcagctgcaaggtcaccagctatacttgcattgcaagacctgtgacagtttgattagctgcctttgttctgcttctataagccctcttgcctgcccccgagtttcatgccatcaaattcccgccgcgccattcaaactagccgaccccctttcagaagtgtctataaagttaagccctgtctttgttcggggctcagcctttggattttcatctgctgggcctcagtgcagtcaataaatcctcctgttccacccattggtctctctgttctcctgattcccacaacagtagtaggggactgcgttcccactttcccctggtctttcatggtatgaataatggacagcatttttttttttcacctatagtcgcaggctcggtctcagtgattgtatgctgtggtcagctgtttttgtttttgtgagaccttgctttcttgtttactgtcctgggacagatgtctgtagtcacttgtttcctcgggaggcaaatttcagtctctgtgggggaggtctcccatgttagctgtggtggtacttggcaggcagagctcagggatctaggcttccgtgctttgtagattgctcaatggtccccaaggcctagtggcttttaacaccacttgaaaaccttagtgtttttccactgtccccagagtcacctcttacacagcctctttttttgtttgtttgactttttctctgagagacagtctcactgtatcttggttgaatcgatcctcccacctcagcctctggagtagcagaggcacgagtcaccacagccggcttatatctgttcttgtttttgttgttgtggtggctgtcttgtttttttaagagttgaagtttctccatgttgcccaggcgacgtgctcccggcgaaggaggccgcctgcctgggggcgggctggagccacgtcccagggctgggggcgctgtgggcactgtgggtgccgcacccaccgctgcccggcactggaggccaagagagcgttcccgacgggctccgcggatgccccgccgcgtcctgctgcccatcctgcccgggttgtcgcgggccgggggcacgacaagaggccggggtctgcccggacgcagcggcctgcagggcgcagctgtccctccaccagccggggtcccctcgctcagcccatgagacaaataaatgaatacataaataaataaataaataaaagatggagtcttgctctgtcgcccagggtggagtgcagtggtgcgatctcggctcacttcaacctctgcctcccaggttcaagtgattctcctgcctcagcctcctgagtaactgggattacaggtgcatgccaccacacccggctaatttttcgatttttagtagagacgggatttcatcacgttggccaggctggtctcgaacccctgacttcaagtgatccacccgccttgacctcccgaagtgctgggattacaggcatgagccactgcacccagccagaagtgggcattaatatgcaggcgccgtatagggcaacatctgtgtgcacctcttacaaatcttaatgctgtgtatatgaggggagtccttcgtgtccccctggggatgtttgaggttgcctgtatgtgttatgtgtgtgcatatttttaagctcagatatgcataggcggattgacacctctgtttgaatgtattcccatgagctcatgccattaattcaccatcacaagaaatatttactgagcgtgagccatgccattccacagacaccattatagcactaagatacaatgaggaacaaaaaatccaggctttctgagctcacactggggtgggggcatggtgggaagacacaggcatcaatgtaataaacagaaaccacgacagggctaagtgttctggaggagaggcgcatggtgtactgaggcccctgacgtagaccccaggtgcacctttgagctttgcttgcatggtttgggtttgtgggctcacctgcatgtgtccatgcatgccccatctgcgtgcccgtgcatggctgcatcaccccatgcacacgtgcactgcccctgggcttgcccacatgtgctgctccccagggcgccaggctatcagcctacaaggcattgtgggtctgggcccagcctgccaccccctacagaggcctgagcctgccttcccaggaggcccaggactctcacccagggcccttccctgcagctggagcaggctctgtggctgcaatctggtgagctggagacgcaagagcccagggggctggtactccagagcgtggagttgcggaggcagctgcaggaggagcaggcctcctagtggcgcaagctgcaggcctacctggagggccagcagcggcaggcccagcttgtgcagcggctgcagggcaaggtcagggccacccattcctgctctttccctcccacgtgttcactttgccctgcccccacccctggggctcaccatcagctcccaatccccagattctccagtacaagaagaggttctcggagctggagcagctgttggagagatccggagagctggagcagcagcagctgagggtgggtgccagggtggggcagaggcaggccctgccctccacctgcccagcctgatgctttaacctctctgccacccaggacgcagagcacagccaagacctggagagtgccctcatctggctggaggaggagcagcagggagggccagggctggcagcatggccccctgggcgagcgcctactgatcccctgtgccccattcaggagtgccagcctggcccaggtgaatgccatgctctgagaacagctggaccaggcaggtttggccaaccaggctctgagtgaggagatacgaaaggtgaccagtgactggactcgcagctgcaaggagctggagcagtgggaggcggcatggaggcgcgaggaggaggtgggcatgggggtgcagggaggccggcgatataagaggaagataatgcacaattatgctagtgagactctcttttccaataatgtttgcacttctcaatactacatttaaaaaggaaataggagcacttgaacggttaagtaagaagatgaacaaaattgaacagaggaaaaataactgtctgaagacatgttgaaaatacatttaaagacagtctgtctgagacaggagctgagctggccaatccatcttttaaatcattgaacatcattcaggtgtcaagtatttgacctggagcctggaaggggaggagagagtccaaaaaaaagtcaaaatataaagaaaaaaaattaaagaacttgtcccacaaatcaggcaaccaaggtctaaacttataccctctgcctgggtaaattgttgttgcttctttctgtgactcttaaaagatgtaccatatacctcatttaatgactttgctttattcatgaaaactctatccccatgggaaaagctgttaaatgaaaaaagatttcttttaagtagaaaaattatgaaaggattccttccaaccctccatacccaaaatatctcaaatgaattatgtatctatcaattatcaatatatatcaaaatataccaattaaaaatatcagttaaacaatacgtcaattgaactatgaaagcaagcttatttaagtagcaaagaataacgtgaaggttagtaagtatagcttatacttaaaatacaatgaattgaaagctcatggcacttcatagagtaggaagaagaaacttaatagaaagtggtagttgggcgagaaggactgcaagggagttatttggaaaatgcattttttatttctgcatcattttgttcacaaattattcctaatcttttgtgaatttgtggatttcttgaactcaaaccagacttaaaaatacagttatagcacagaaaaaaatctttaatggcaaaataaaagctaagcaagagagcctttcaaaacacatgaaaataacacacacatacaaaaaaaaaagaataaagagatgtacaagtgacacctcctcaaccttctcacttggtgtacatatgcacagtaaattattttgggctcagccaagcatgggagcaattcaaatagatccatatgatattctctgattagaaactcttgtggagtaagttggtgagtgtatctttgcctaaaacagtcatgtcaaaatatagcttcctatagcatatttatttagtatcattttggtgaaaaagtggttatacagaatagaaaagagttgtccaaaactaagtggttgacctttccagagccattacctgcagaattgttatgtaagtctgttccatactcataaaggaatactcagctgacccaactgattttctcgtgttttttccttcaagggctagtagaagtctatatgttgtggtggaaaacaacctcagccctatagtccaacatttgcctatcaaaacttgtcctatgatttataaaactagaacctcactggtaagtcacattcctagagtctcccccatccctaaccccagtcacggaaaataaatcaaatcattgtcactctttcttaacaaagagcatacatttaaaacttgagtaaaattacaggtaccgtctgggtccttcaagggggaacttgaagtctcaataccgcagttgtccaatcagaggatccaagatgaatatactcaaggactttatgcttggcatcctctggagacagtacataaccaccagcttggtttaactggagattcatttgggttaggagaaattatgtaggcaatgtacttagtcaatggaggcctcatccctgaagacttacaagaatctgaattcgtatgttacttttcctttaatggagtggaattccaaatgaaaataatcaaacagcatgtgcataaacattagatataatacccacatttacaaagcctttatagatatgcaagtgttattgcgtctgtccctagcttctgtacagaatttaatgggtagctgttactattttattgctgtataaaaatgaggaaactgataagttgtctaaaggtgcacaatcaaaacacatcaaagccattgtgaaatacaggtccccggatttcaaaaacagatcttctgcttataaattcagtctttttcatactgccataaactccagaatgggaaaacaaagttactatcagaaaagcttcttttagctgggcgtggtggctcatgcctgtaatcgcagcatattgggaggccaagacaggcggatcacttgaggtcgggagttcgagaccagcctggccaacatggtgatctctactaaaaatacaaaaattagctgggcatggtggcggacacctgtaattccagctacttgggaggctgaggcagtagaatcgcttgagctggggaggccgagatggcgtagtgatccgagatggcgccactgcactccagcctgggtgacagagtgagccgacatcgcgccactgcactccagcctgggtgacagagtgagactccatctcaaaagaaaaaagaaagcttattttttcccctaatcaccataatattcactattaagtgagggaaatagaaataatttatttagcaaatcctttctagttcaaataatttgtatacaggctgtgcaaacataataatgagattctttttagtcatcttgctttatatcactaattacactcttatttaatgatattttaaagaaaaacgtgtttattttcaagtagaaaactcatatctgtccaccaaggaaagctgtaacaaatgtaaaatacataaaaaagataactgctaaatttctaaagcattccagaaaaagacaaatagaagggtgtcagattaggaaagtatgtcttgtaaggtgtaacggacagactgatgagcttagagatgtggatctcaaagtggttctcagagcaacagcatcagggtcacctgggaacgtgttagaaatgcagattctcaggtaccatcccacatttaatgaatcagaagctcagagtagagaccagcaatttgttttaacaagtccttcagggattctgatacagctgatgtttgagaaacactagctttaggtaaacgtaagagggtcacgttagtatttttaaatcattggaagttggtttgttttgttttttcttaagtgggactcatttatacttcaatacacagaatggatatttagaggaagtcgtttttgacctaacacggatgagcatttccaattgaatagcgctttctgataatggggctgcccactacaagtgaataactgggtttctctaggctggagctgcagacaggtcactatgtgtatggaggattgtattaatatgatcgtggctctttatagctctgcattactaatattctgttttaaagtctctcctcaatatccaatgtctctgtgtgaatgatggtaaggagtgggtaacagtaacaatcatcctgttgttgacaacagatgataagagaaagcccaactttacactctgtataaccttacaccaatgccccattcctcgtctaattttttttacatgttaacacatgaccttggcattactaaataagaagccctctcacttagaacccgatgcagtatgataaaaattattttgagaacaatcaggagctctagttttcaattctgcttctcttctcaagtagttctgtgccttagtttcttctttgtaaatttaaatggttggaacagaggatctgttaagtgtgattcaagctgaaattgtatgtagcccacactgagtttctctgctatacccctaacccattcaacaatcacaccaccagttttcaggactcacagtaggatagccgtctatcatttgttaataggtgtgctctttcatccaaacaagaaactcatgatttctgcagttttttattctagccaggttctaggtgctggcctggaactataaaacgaacatttcacaaaaagttatgacaatatacaaaggaaagacaatttctttgaatatccataatctcaatatgcagtctggctgtggatggccaagagatagtttccttaactggaaaaagcttttaaatgaggcttggtggaagatatatctttgcatcattacaaagaagaaaaaagagaaatctcacaactgaagaaagtgaaatccactttacttaatgcggacctctgtctctggtgtgcaggtcctctgtgtccaaagataattagcactttataatgctaattattataattaggtctgagaaaaaaatcattagggggtaggcccgttcactgattttcaactgccccctctatttaaaaataaggtcatttttctatgaaatacctttaggagctcaaagcagaaagagggttatagaaaatcctgtgtaggtataagcctgagtttttaatattcttataattctgtgatgtgtctggaaactgaaccgggaggaaaacagtgaacctatttagtccaggagactagaaatcaggactcagaagagtaaacatttctgtaatagttagtcctcaaatagtcattcattgaccttccactgggtgtctggcaatgtgcaagctgcttctagatgctacctcatgtaacaaccatcacagttgcacagagcaagtactagtactccactttcatagataaagaagtaaaatcttagaaattagctgcccaatgtcatgtatgtaggaaaggaaagctggattctgattcatatttgctggctccaaagcacttgttgtaaatacttcactatcctgtgcttacatgtaaatgtaccatttctcttaggggtcttgaaatactgaaccaaagaatggtgtaggggaagggcagtttagaaatacctggaaatttggttgtttgaaggaagcccactctcagatggtaggagatcaagctaacagaatagctgagaatattttctgaggccccagaagtataaaaacggtctaggggggaaaatttgggacacagagtgaaaatagcctgcctctgaagaccagcttcatttcttcccctctgggtgttaatgaaagagcctttaactttgccaggcctcagttactaatttctaaaacaactgctgctactattactacggatcttactgctactatgaccaccaccaccaccacatcagttactgagaactgaactagatgccaagcaaaaatggtaaacacttcatatacattatctttttaaacacaaaatgtactattaatccagttttacatataagaaaactgaggctcaaagaggctaagtaatttgtatgtgaacatgctttacactatgtaaaacaccttattagtagatatcactattattaagaacctatcagccggagaggaagaattggccttttatctttctaagatgcacagttgtctttctgtttaatggttttttaaaaatccccctgtgacaagctccagaggacaaataatttgtttcttgtggtgtatggctctctaaatgaattaattgataggcatcccattgtcagtctcagggatgtggaaataaaacagacatgagatgttttttaccaaactaatttgtgctttaaacacataaataataaatatatatatattaaagtaaatgtgtatttaccgtctctcctgctccactttgaattcaagaacccgtgtctttgttgggtcactgcactgtcaattgagaagtttggttttgtttctttgagtgttagtaagtggcattaaatggtaaatattgccgggggaaagaaaggagaaaaacagctcttccaatccatccctgtttccattcaattaaaggagggtagaaagaatacttaagataattgtaataagtctaatagaatagcaggagccactcttttcctttcagtaggccattagctcagaactattttcagagtaatactaagatgatatttgccttttcactgtgttggcacttgtattgataaggcaaaaacagtggagtcttagcaaaaattaagaccatgaaaacaaactgcactaggaataattctcttcttcattactgtttacttgcagggggaaaaaccattttcgtttaagaaagtccttggtgaagtagtaaaaatattaattttattaaatctcaaccttgagtacaagtcttgtccttgactgtacttacaagttttgtcctccccaaagcatatggcgtcaaggctgggcctaacccagtctcatgaccttgtgaatccagtccacaaacacagagacacgcgtgaagacggctggccagcgcgaccttgtgcatactcggttggggattctaattcctttcaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcgctctcccgcacatgtcctcggtgcttgatgttacactcctggttggagatgacgttcagcaaggccacatttaggactgtgtcattacccgtacctgcagtgaggggaatggggagaaggagacggtcctggaggaagatccagggctgggcctcctggccaccagcagtcctgtgcactatgctcttacctttggtctcaccccagcctgcaatctcacacttggtccctggaggcaccacataccattcaggcggcaggcagatcagggccacacgctggttcagggtcacagatctttaacaagaatgggggcactcagggtctgaggccacaaggctcagccccacctcacatcctcccaggttgtccacatacctctccagcttgagcaggacaagctgggagcctgagggcccacacagcatcttggctactgggacccgctgtaggcctggctctccatgttgtgggttctggaacagggtgcccaaccatacctcatagcccgtgagaggcatatggctgggagagaagctctgctaggtcatttgtgactctcagtccgttgccccaaggctcacttgttagcttgcctggggaaaggggaaagtgggatgagactgggtccccaaacacaagggaggctcaccaggaggagaagcactgccgggcagtcagtatccactgctcctttactagagaccccgcgcagaaatgctggccctgcctagaggagtggggaattaggacagggaacagactcctgggacagatgctagacctgccatcttctggctaggacctctgggggcagggatagattcccagcccccagtggcataaccacagaggacacaacctcagctcctctctgtgggagacaggcagttgtgcctcaccgattccgcaagctgactgtccagggtgagttgcccggatggcccccagccacgcgcagcttggaacgacgctgatccagccgatccaccctcttgccacacttctcaaactgcacctggtctgtaggatggggtgggctggatgaaacccagactgtgtggatgtcgtgggctaaagggcctgacccataactggcccaactcgtaacctgggggggtccaggattgatggcggctggtcatcagctgaaagacaaagttcactggggttaagggagccagcctttggtggtgagggctgaggtaaggtcatggggcaagcgtcactagtgctcaccgcagcgtcgcagggcacagtagtcgaatggggtccttgggtccatcgtgtagcaccagggcccatggctatccccatctgggtctggcagaagttctcctccagttgtgcatgcggttcggaggtaaatgtgaaccgaggcgggagcgggagcaaaatcgtggcagggtagtctcaaccatttccaggctctggtcccagacatcaaagcatgccgccccagggttagggccctggcggggccgggagcaccagggactcactgcagcttgtgcggcgtctcagcggaccagcgctggcactggacacccttgcgggtcttgctgaccgtgccgcggtactgctcccccgcgccgtggtagcagtctgcggccggtgcgggcagccatcaggccgagacctcgccccggccctccggttccaggcttccagccccggctctgtagcccccaagcttgggcctcaccctggggccgcacgtcgtctgtacaacgccggatctggtagcaaaagcccacgcgcgtgccgggccgcagggtgaagcaccagggcgcctctgagccgtcgaggttccagcagaagttctcccgaaggtctctaagcaggcgctccactcagccctagcccgccagcctccagccctaagcccgtgactaccctcctcccgtctcacccgcagcagcacgtcccaacgcccgcccccccgcccacctcacttgcacgcgtatttttctggcgtaaatcggtgctgatgtgggatttgcgcgtcccaacgctggcaaggtacgccgcggtggtggtattggctgtgccccggtagccctcacccttcccgcggaagcagctgacacttgtggcctcttggcggggctgtgcctcggacccttagatggaccgagataggtcgggccccgagcgacagctgagatccctctggggctgggaccaaacccgcctttcccaggtgtacggtactccacgggatatgctctcaggtcacgcccagcccctctgacctccccggccaagccacgcccctccccaaggttcccaggtaccctcccaggcctggtccccgccgcctaccgcagcgggggaggtcacagaactctcgctcgatctgcggatccgtagtgtagcaccatggccgctcggagccgtcaggattccggcaatagttgtcgtccagaccttggtcgaggaacctgggggcggtaatggggcgtgaagaagaccctggtactctggcttatctggccccgcccagttgccctacacggagccctgcccctggagtcctggaccttccctagcccggcccccagggcgccgataccgcctacgcgtacttgcccggctcgaaggggtgctggtgcgggtgctgaagatcccagcgctggcactcgcgccctgactcggtgcggtctaccgcgccgcggtattcctcgccattgcaccagacacacgcggctggagacaaagagccagtgggttcgtggatgggcgtgggcttgcccctccactctcccagcttgacccggcgccgcttacccacccggcaggatttgatgctgcagctctggaagcgcacggcagggtctgttgtgtggcaccaaggacctccggggtcgccatcagggttacggcagaagttctcttccaggccattccggagcgtgggcatgtacctgagggcccagagcatcactatagtgtgtgctgggggaaggtcccaggccgggacggagggaaggtgtttgtctcacttgtgatcgttcgggaacttgtggctccaagcctggcaggacaggccacccacggtcgtggccatggtgccccggtacccaaccccattgttcatgatgcaggtccgtatgtagtctgggagcaagagacagaagatcaacttgggctgaggtcccctgtctcccaccctgcccctctccacccccactcgcctttctcctggaagaggtcacagcgcccagaatgccacagccttgagtggggcgagtgttgagtccatggcagcagttggcaaccatggctgctcacattgtagtggaacgccctggagagaagaaggcacagggtaacgccacggcccaggctcccctgcccccagtcttatctaggcccagtggccactcaccagcagtccattaagggcccacagcgaccagcacactcttcagcatctgccacatcctcctgccaaggcccgggcaccaccgcatgtagcaggtgctgtagctctgtgccccggagcacctggaagtcattcgatggcgagcgctgccctgcagagtgggcatgagtgggtgcaggtcaggtgggcatacatgtcagtaatgtgtattggcatgtccacactttgttcattcaggggatcaaagctacaaggcttctgggatggaccctgtatgcactttcaagggccagtctagcccccctgcacagatacttgtcaaaaaaatttcccctgggaagcaggcccagacttggtagttatcaccggtgcctctgtgtagtggcccaggcactgggctcagatctaacacatacgctctgtgagagcagtgggtgatggagcttgccccatctcatctctcaaatgagaatgctaaggctcagagccatcacattacccagccaggggccctggctaggcattcagactccaaatctgggctctcacctgcacaaaggcatacgctaggttagaggggtagatcaggctcaggaggggtcatttcctgctgtgtgcgtgcatctgtgtggtcctaacactgcttcagtgctagagcagacgtgctaatagaggcctaagtgggccgtgtctgtgtgttcctagggcttcccagctgtgctcaagaggccaaggtcactgccccatgcccactgagcctctggctccccgacttttttctcatcccagaataggagaatagggccaaccccctcctgaaggcagatggggatcagggttgggggcactcaccagggacccctaagtattgagtcagaagcagcaggagtgggagccactcctccaggatgacttcatcttaactaattatatgactatgttgactgcaacatatgtatgaagtttcatatactcaattcctttactgcttccttgagcctatgaaccccctcctgcatctcctagtcttcactgaacattatgtcaattctcagcctcagctctaaatgctcatggtttccaaaaacatatttacaacccaccataggtcctgagcaccaaagcctgatgtccagttgcccagtggacagacatctccactgggacatctcataagcactaaaaatctcaatgtactgaaacctgaatttatatttctctccccaaatgtgctccatttccatcttccctttctcaacatccatccagtggaaatgttgctcaaacccaagtccagagccacccttggcacgctcatcttcctgagccccccacttccatcggccacccaggtgcttgtcagtttgcccactttctccctctccacagcccttttcctagttcagaccttctgtctcccttgttgggatcatgtcaacctcttcctcactcgcctctggctctgggcttgtgccttcaaccgactcttcaaaccgtagcaagagggatgcctcgaatcacagatcagatccctctctccttaaagccctgcagcagcttcctgtggctctcaggatagaattcaaacacttccaggatctgggcatctcctgcccctccacagccctgcctcgccctgcattccagccccaccaaaccacagtcagtcccttccatggttttggatctcttgtctgggaactttgcacctgctgttctctctgcttaaactctcgctttcacccatgcgacctggttcactcctcattctcctgcatgtctcagcttggaagtcacctcttccagaaagccttccctgaccctcaggtccaggttagatcccccacctggattcccacagcaccgtgtttttcccctaccacaaccctagtcatgccctttagcgaacagccaacagttactaagcacctgctgtgttaggctgtttcttaggactttataagaaagatcacatttaatcctacgaagtaggtactgctattatcctattttttagatgaacaaactgaggcaagagcagtcacacacacatagagtcagtaagtggtaaagttgggatagaaaccaagacaatctgactcatggatgttacaccgtgtgttagaactagccttgaaaaaaagacacaagcttgtgccctgtgccaagaaagtttctgataatggtggcggtggtggtggtggtgggatttaatcagttggcagaagtctgtatttctaacaatctctgattcaaatgggcaggacccatgtccatttctctttattgcaattgtactatgtttcttaccttcactctgcaacaagcttggtgaagacagagaacatgtatctgaggcccttcatctcccctcagttcctagaccagcactagcccatagtcaaccctccatcaaagtagagggagaaagtaagtggcttttaccctgtgctttctgaactcctgggatgctaggaagagccagaaaaccttgtccaccgaacccacaaattcactctcttcatcccttcctcactccacttccttcccagtagttgttggagtttttgaattttccctctgtgagcccttgccctcccctgccatgttctcagcaaaggccctggcctccaggtccatgagaacaggattccctgtagtaagagctcttccctagcctcctccacttccaaaggggctggaatcttcaccccttgatcccttccctttttagagcacagaggaagcggagccctcctcctgccctgggctcccatgccccacatgttcctggagagcacccttgggccactgttgtaactacatggtgacttgcttgctctcatccttcatgaccccccctcctcccatgccccactttgttaatttcactctcctctcaaaactccccacagtgccagtgatggggtataaatgcagctgggcaacgaggctcccacagacagacccaaacctatcttccaagtgttaatttcttttctctcctcttcttcaaataggtctcttccttacacatttctgccattcctttctctctctgccttgcctctcccttttctcccggccacagccttatccaacctcccagcccagcttggactcagctttcctaggaggctcccagacaatccagtgggctctcatttttttgagtgtattcagcagttggctgatgctgcatctccagcacttgccctaggttgttttatctccctaatggcctgtaaaccccttgagggcaggatctggcctttgtactctaaaaaggtcttcctactagagaatgctccacacatgtgtgatgcttcggggagtcccaaccttcatcagagattcccactggtgccagctcatagctcatcatgacgtgtcccagatggtgactgggagtagcctatgccaagcaggagtttttccccgaagtcttcctgtttattgcaccgggctggctgcaagacattgaggatgctgccccaggggccagcagggtgactggggcaggcgccatgatggctgtgcctgggtgctggccagtgtggccccaagaagaggccgggagccagagctgcatgccctctgtcagcaccagcctcctaaaaacactctcgactttctccaagcatggattgcctgagctcccctcctgctccccaaagaggccggggaacaagtcagacaggggataagtcagacaggctcagctgtgggaggctggaggaaaaagaccaataaaactgactttatttgtaatgttcccatgtttgtgattttgttatttctactctgtttcctcagagcaatgaaacaaggaaacggaacaaaaaataacaaaacccagctctaagtatacgtgaactgtaaggcctccctctggcctcctctcttcctccttcctcaccaggtttgcctggctgacccttccagccagtgaattcctttcccaggttgagtgttttccattttaatttttgtggcatttccctggattaatggttaacgcattcattttctcccctccagcctccattatcaaagagtgctttgaataaccattaactctctggttaagcgaaagaaacacgttaatcatctacaagtcctggggcaggaaaattattcttggtaaccttctcccaatggcaagaaaaccactgtccctgagcagctcaacttcagccacacctgggtctacaagcttgcaaaacccctccggtaaccttgttacaaggacttggtaaactgaggtcataaactgctgaatggctaagcgctgtgcttttcaacccagccaccaccggttctctaggaccctataaagagacaaggctgggctgctgcttctccctttacttttaaaaattgttttgccagtaaagtctcatctattgtacattccttgttacggggaaactcaagtggctgtacaggctgttcttggagccacagttaaaagcgctttgactcaaacacacatgtggcgtcatcctgagctccgtttgcgtggggccggaacaccggactaggaaacctctccctgctttagcaactgagtgtggctagattgagggaccacagggggtggctctggatgcagcaatccaagtccccttttcagggagggtgacctctttccgaagttcagtggatggcccccttccagggttagggagacaggaggaggaggaagaagaaaaggaggaggaaagctctcaacagccccccacccccaacccatccaggagagaaggactgcagtccccgagaccagctggaggagtggcgtgtgcatggtgtgccctcagggtagagcgcgccatcttggagagatgcctctttcattcacaaagcggatctgttgcagagcccagagccccggggagagcagggcggcgtccaagtgcttgctgggtttggcttgcactccctctcccttaaagaagacagaggcggaagggagaggctgttcttcggaggcgagcctcaggcactgctagacttagtaggaaagatattgctggggtcttggcaagccgtaggtgcagcgctccccatcgtcattccggtgcggctggttactgtcaccctgcctcctccccgccggcctgagagcctctctgttccagatccaaacatttccacattaggcagcctgcatgtgcatttccctggcagtggagggaaaggcacccctgtgacctgggatgaccgacgacggggacttgccctcctcccccacaggtgcacttgctcttttctgggccagccttgtgatctggtgtccgggcacttggcagcatttagcaaatgttcctcagtgctctgtttggtagttaatgctgttgacacggacacctttgggagcacgtgggagaagctgctgcctccgtttcccccgggttacagcgcctggcgcagtctgttgtcccctcagaagtggtgggcgacattatctcctttttcatccctagccctctcccttgaagctgtcctgatctctcttttggacccaggaacgtgagcagaggttactactcactatatatacacactgcatctagactcatgcatgccttcttggtgtcaaggacacctcacatttcaaagacttcatgaaaaagaacgtgaggtatctcacacggtgacatgataaagctttggacaacgtgggttaagctaaaaacaggtcattacaattaattgtatctctgtcttttgacccttcagtggctcctgaaatccatcacacatgtggcttgcaagtattttggtcggacaacgctgccgtagattgtcccactctgaaatggttccctctgggcttacgggactgctatagaagggtcctaaggtcctgtgcctccctgcttttcaagtggctgcaaacttctgtgcctaccgcttcctccactggatgtttccttcctgccctcctccctgaggacctcctagtccctcttcaggatgcagagctggagcctccactccaggaaagccactcatgttgttgccaacacaaccccctgcacacatgcagtattaggcattggtctgcctggctgtccctgggctgtgctgtccttgagggcagtttttgtgtctaattcccagagagtgcaagaacacaagcatgctcatccagacgttagtaagctgccctaaggggtggagcagtcagattccggttttatttatttttcccctgcaaggagcaatcaattattaaccgaagtcacgatactttggttgctgttatcagcacatgaaaatatcagtcaaggctgggtttcagacccgcctggcactattcaaaggaaattttttagtaattcttattttattaagagcactagtatattcagatcaagtaaaacttcacatataacaggttcactcttctatatgaaatgtttgtgggaaatctatcatgcatcaggtgctctcaaaaggtggtgaggtgtaaatgtcagcctcaaaggctgcagtgtccaacatggcacacagcttgtgtggctcttagcacctgaagcatgcctcgtccacagtgagatgtgccgaaaatgtaatatacatccagattttgaagacttggtaaaatatctcaccagcaattttttatattgattacatgaggaagtgataatgttttgggttggttaagttaaacgtattattaaaattcatctcacctgtttctttttaaaagtggcttctagagaattttaaataacatgtagttcacattatatttctatgagacagtgctgctctaaggcgattatgctttgtttgttttgagacactcacaggtgtatgtgagcatttcaaccgggtttataacagcttaggaaactgggaactttgacttggaactttcccgccaagtgacaaaacatccgtccagtgatagaagttttaattctacttcctccagctagatcttgcctggaggacccacgttgacttactctctccagaaacggccccactggctctctgggggaactcctgggttctgcagggacttgctaggtagtaattacaggtgtgtagagaccctcctgcttcatacgctcagtcatcattatttacttttaccaggcaccaggggcgtgatgagagcttagctgaaaggagagaagactcagcaagcacatcaccttgaagctgacctgtcagccagatttcgcagcacctgcctgttccagcctgaggggctgcgattcattccttgggaaagagagctgcaaattccctctctaggccacagtccaaatccttgctcttctctctcaggttctggaagacagaatggaggcatctacagagcaaggacatgttttctacctgaattagcttttctgacaccttgaaaccatctctaagaaattgattttttaacatacacatatacaggtaaacatttaaatctgtgccataatgtatttgcacttcgagtccccctgaagtcctaagtcacatgcttctcttcctaggggttctgtctgaagcagagacccctggattggagcagtgggaagaatcctgatgaatcaggtgttcctgcctgtttacattaactgggcaccctgcctgcccaccccacatgctgaatactgctggggagaagagaagaaacatttattaaaggcaaggaaaaattagagccttttcattgaggtcagaagatttttgaggttggatcggctggccaggtgcatgaccaattttcttggctccttagaagcagcaaagtatttgaaaaataatggagcccttcgtcctacaagtaaaagcccatttatattgggaattttttaaaaagtgctggcgatggaaaatttccgatgagatgcatttcttcctgcctgaatgtcttgaatgcctgctggatttgtctccctgctaagacactcacacttgcaaatctgtgcttttcaaggtggggagatgaaaataaaaagtctgtgacatgtatttctgggaggcctgaaaacaggaagcaaattggaaccacagcatgtggggcacggatgctggattctgggggatatttgcttatttggaaaggctgcaaacattccatcctacccactgctaggagctctgcactttgctaacgtcccatggaaaccaaggttctctttaggactcgacaggactgggttatttttctcagcttaaattgtttttatatggttatcctcagtactcttttctgttttgggatattttcatactttttattttttaaaaaccccagaatatcttgattttgaaaaggtacattcacccaaataaagtgcccagcgcatagacaaggctgcctcaatatttcacgtgtcaacagccaatgcccccggtacgtgcagaaaagcctgagaacaaggaaggaagaaaagggtctggtccttgctctgcgggtatttaagcatttctcagccccctcctctgacttctcaactatgttcacctatatggcctcaaatggagagaactggggttataaaagaggatattagctatgcctgctatagaatgaggaaggcatttcaggatgtgcttggggaggagatggaatgaatggcaaaggggatgtttgtccgtgagggtggtctgtgatctgtgggtgggggatgtctgtgcagctcccttcatggcctctcatggcccacacagtaggcagtgtttgccacacacagaccctggacaaagtcacagagtggtgttggtaccatttcataggaggggtcctaggggacattctaggaagttcttcatcagcttaggaaggtgcagcctctgcagtcattaaacacagtctaccagccagagaagcccaaaagctgctgctcctgctgttctgcgtggtgtgggaaactacggcattggcacaactttgggagctctctttgatctcttgtttgtctgcatttcccatactcttccagtcaccaagtgtcatcattcttccccaggttgtctctgtctcccttccttttctgtccccatgactcttacctgtatccaaaactatggcgtttaaggtgaaagagccagtctgtaggagctgcttcgaggaaagtcttgcaagactgccttcttgaacttggtgctcaaactcccctctggcttcacaacctgcatagttgcctgggtcagaaacaggttcctcaggcaacttggtgttgcattaaccaagtgacactgattgtcacttggaagacactcagtgactgactattagagatcatctgcctctcattttggggatgtgaaggttgagactcagagaggtcaggcaacatgtctgaggtcattgagccaactagcagcagccccagagttgtcacccagatttcccgactccccattcattccagaaaacctacccatggggaatgttctgccaggctgttctacatcaccagtagagagaagttgccttgagtattcggtttggttttgaagttaacctattcagacacacttgagcatgcagtgagtcactgactggattcattcccagacctatggactcagcacatcagctcaccaagcctcctgcatactctgcttctacgctggacaactgtgcattttgagaagctggaggaaattgtttggcatactgttctaggccagcagtcatgcgatactgagctaggcctggctcctataggctggtgaaagccaagtgttaactgttcaggatttttttgagttggttaactattgatagcttcaaagtcgccatggcaggggtatttataccatagaaattggtacatgttacaaattagggtttcatttttcaccatccagagatctgatttactaactcactactgattctgaggtaggaccccagcttaggaaggcactttcaggcaagactgttctgcggtaattagaaaatggagagtggccctgtcagatgcaaaggagaatatcaaatttggaaaaaagtactgcctattgcacaagaggtaagagtcactgagacatcttgcaccagacccaagtgagggatggaaggggccctgatggtcatcttgggacagcttcttagggtcacccaggagcccaggagccaggtatgccactccgtggtgggacagaaacccctgtaaagagcaagcagacactcagtcacccaggaccctccccaacactcccattccctgcaatctatcagcgcatcctatcaatcccgtctggagtagatatctgatcatgccttctctcccttgtgactgccatcacccaagtccaggttcctgctacatccttcctaaaaggccttcccctgcaagcttgcctacctcacatcgactttccccacatagctgcaaaagtggacgtctgagaagaagggggaggaagaggagaagaaggaagagatgaagaaggcgaagatgaagaaaaagaagaagaggaggaagaagaagaaggaggaagagggggaaaagaggaggagatgatgttatgtcatcccttcacccttcccctgcacacacacacacacacacacacacacacacacacacacagacacacacacacacacacacacaccacgaaaacccttcaagagcttcccattgtacttagaataaaatccacgcttgagtaaagctctgcatgatttggcccctgcaaacctctccagcctcctcttgcttgggagcctctgtgctcacaactctcctgtcaccctggtcttcttccaggtccttgaatgccggctaagctctttgctgccccaggaccttcgcacctggtcttctactggcaggaatactgtttcctgagtcttcccctgactggctccttcatttcctttaggtctcagcttgagtgtaacctcacagggccatttcctgctcacctggtgaaaagtcaggcctcgtctgttctctgttttagctcctaagtttctttatgacaattatttcagcccacagttcttttatttacttgtctgcttacattttgttttaatcttttctttacttccccccacttcaacagatgctccatggagaaatgggttaaccactgcattgccagagcctggcatataggggtgctcaaataaagacttgatgagtgggctgggtgtggtggctcacacctgtaatctcagcactttgggaggcaaaggcgggcagatcacctgaggtcaggagttcgagaccagcctggacaacatggtgaaaccctgtctctactaaaaatacaaaagttagctgggtgtggtggtgagtgcctgtaatcccagctactctgggaggctgaggcaggagaatcgcttgaacctgggagacagggattgcagtgagctgagaccgcaccactgcactccagcctgggagacagagcgagactccatctcaaaaaaaaaaaaagttgatgagtggttcattctactgccaccacctatgggaagacaggtcaggaatgttgaaatgaaagaagtgcttggcttcctctgagccccagctggacacaggcatctgtgatgcatccagattcaggctgctcatggactctgaggactcaacgctcccggagggctagcagggagctttgcacacatacaaccagttctcaccaagcaactggggattaatagtgcaaggggttaaatgggttcaaactgttcctcttaagctccccaagatggtgaaccgcacttcaaagctgcttgaaaattcttacttggtgagcatgctgttctgtgtcccttttgggcagaggattgggaaggcagccaccaaggccgcctgccgagtgaacagggggagggggcactccaggtgacgtgtgtgcagagacccgctcatgcctgacccacagttagtgcacgctcacagtggttccagtcttgtcccagcgacccgactggcctgctttgttattggaactagagctgatgattcactttaaatagatccttaacctcacaatttgtttttcttgaaacggtcctgagaggtgctttccaagaaacaaggaaaaaactgactgcacagtggtgactttgagtctgtctgcagaaagcagtgtgagtggatggttcattcccatggcaaagcctttccctgtcacccggtgtcagggacagtgaaaaaaacgggccgtagcttgggaaacaggggtgctctgcagttgccgtagcaggtcttcagggagagcttacgggaacccacggtgtaggggcgggggagggggactgggtgtgttcatttcccggggatgctgtaacaaattaccacaaactgggggccttaaaacaacagaaatgtattgtctcacatttctggaggctggaagtctgaaatcaatgtgtcgcaggaccacacttcttccttgccgctttctggcttctggcgcttgccagcagtccttggcagttctcggccggcggttgcatctctccagtctctgcctttgctgtcgtgtggccatcttccctctgtctctgtctctgtctccgtattcaaatctttttctctttgtgagaacaccagtcattggatttagggcttgccctaatccagtaggatcttattttaacttgattacatctgcaattatatcctattttctaatagggtcatattcacaggcatcagagttaggacatcagcatatcttttggggctggggactcaattcaacccaccacaggagaggtccccttgctactaggcgggtagtcatatcacacgcacatgtcgtaaacatgctgagcagacgagaacccaaaatctctgatttgggtaagatgtgattccaaaatgtagagtgcagaatttactaaaacgttttgaggcttagagtaagagactgctgcagtttaggaagacttcctcattaaaagattccaaaagacatattccatgagtcaccagggtagactgaataatgagcgctcaaagatgtccgtgctgtaatcccgggagcctgtgactatgttaccttgcatgacaaaagggactttacagatgtgtttaaattcaggatttgagatgagatgatcctggattctctgaatggatcttctaagaatcacaagggtccttacaggagggaggcaggagggtcagagttagagaaggagacgtgatggctgaagcagagatcagagcgcgaggggttggaggatggagggaggatctagaagaggaaagcaggcagcttctagaaactggaacaggcaaggaaatagattttcccttcagagcctctggaaggagctgaccctgctggacgcttcaatcctagcccggtgagactgatttttttcttcatgacaagtcagttgatgttgttttaagctcctaaatttgataattggttacagcagcaataggaagcattgcagtcacatagcccagtttggcatcttgtattattttaacaaactctccatcaatccacctgtgtatcattttagtctgctaacaccaagaacaatatgttgcatgtggaagaccttaataactacttgttggatgcatactctgagagcttattatacactcggtagtatgctaaaccctttggatacatccctgtcctcctatctatcagtgtggaggagaattggacattgaacaaataattttacaaataaaacagacattgatttatgtgacaagtgctgtcacagaaaaaccacagggagacatgacagggtagagtcggggaaacctaacttcaacgtggggtcaggcagagccttccaggacactcccagctgaagccaggactggacataccctcgcttggttccagttttaaagacaagacactttgcccaaggaggtgacccgagttgagcactcggagcgtccaccatcttttctgaatggtgcgaggttgtctgttgttcatggagctcgtgtggggtaggccaatccctggtctgaacttgaggcggtgacacattttcatcttggttctgccgtaggtttagcgggtgacctttgacatatcgtctgcccttcctgcatgtcgtttgtgctctggctgacaaacaacgatctcaccagccatcagcgctccacaggaatgaaaagagtgagtgaccaggacagggagggaggaaagaagaagttgccttgttgccacggccttcctcagatgtgcctccgtgccttgggtcacccctggggctactggcaccttctgagacagagccggggctgagggctagattgtcgttcactgggcacctctgcaccggggaaggggacgggagctgaggagggggcactgagcaaggcagaatccttatccccaagcagttgctgacaggtggagagacaaatgcaaacactcagaatgcaaacacacagtgtccaaagcagaagcagcaggaggggcgtgggctctgccccaggaattcaggtgcacagaaggagctgggcctgcagggatactttggggtttggtaaatgaaggcggggtcgtgcactctgcggtggacaacaagagagaagcctccccacacatcagggttacacgtggcttggggtatggcttgccaccttctcccgtttctccccacatgagcaagggcggtgtccattatctctcaagcaattcctacctccctggcactggtagatgctggacacatggtacctcctccagcctcacaacaacactgtcacatcgtcacctccatttctcagatgaaactcaaagaggtgacacttgtccagtgtcaggtggctgtgaagatcccagcacagtctccttgcatccaaggccctagctcttaccacattgttgatcctgggttgatggtgaaggtgtaagctggggttcctccccagcccctacctgtcgtgtgcacacctggccttctctgggggtgcatttcccagctgaggagactgtctgcgtgtgtggctccgaaggaagcctagctggtgagttcagaacaggccctgtgtgtgatgtggtgacctgaggtcataggatacagactgcgtcccaggagcacctgccattttaggggtggctcaggaaagcctctgagctccctggaggaagttgtcccctctccactgctgcaaaggagagttggtcatggggccaggcagacactctctggacatgctcgtggaagagctctttgggagaaaagacactcgagcatgccaacaaggggacttaggggccagaatgttctgccacttgccactcgccaacctgaaatctgcacctcctaatcacctcctctcagccctgcctcatcaagtggggtcttgcaggaactgctggcagctcggccaccatcggggaaaacaccccagtcaaacacaggctctcctgtgccttggcatagagggaagagccagccctgcccccgcccctgcccactatggtctcaggattcactccttgctgaagcctttacaggggagccaaatgccctctcacccaaggcccttccaaggccctcccacatcctttgggtgaatctgtttcaggagcacccatttgagggaaaacttcgtccccaggagaaatggcaacggagaggtgaaggggtggaggtacgctttggagcagggccaaggcacatgggggtgggctccagcctcgagcctgtccttctccatgatcctgaacatgactcttctggaacctggccggaagttgcccctcaggagacagcgggggaaggaagttgtggtccagaaactccagaatgcagggtgcccttcccattcaatcacggaggctggtccaggccaagagcatcctcggcctttgtttaagctcccgtgagttcttggttgacctggagaggctgagagaggcccacaggacctctttccttctgacccttcattgcctttggatccagctcacctcagtgcaagcctgtggcctgcaggggaggccctgaggtagaggcactcagccctgataccgtgagggacccttgaaagtttgtgctcttgtttatggtctcaaagacaagaggccaaattcctcagctgacatttttactgtcaggacgtgccaatgttgttcactttttgttttgctttgcttatgattgtctggcaccttgagatgatgctgagtatgccaggctataggatggagatgtgggtgggagcaggcaacagactggccctgatcttccagagctgatcacattctctgacgtcagctctctctgttcatgtcctttgaagggcaatggactccgtgaggggagacccgaagtctgtgaatgcccagcttctgagataccgtcaatactgttgactgcatgaatggatgaattgcaagtgagttgttgaacacagtggcaaggaggctccttactagcttggaaccccctcctccggcagggaaagtgattaccaacctggaggtcagccaggccaagagggctttgagatctacaacaccatctccatctactgggtttgggttacgtgttttaagtggctcaaccttcctctgaaatcatagcaatagcaatgaatgatgtcccatcaggcactgccctggtttttttgcacacactatctttcatccctataaggacgatgtgggatggccattgtcatgttcctttcacagaggtgaaaattaacactcagagagagtaggcatcttgctcaaggctagaatggggtaaagccattcatttaatttatttattcaacaaatattcattgccaacctgctataggccaagcccctggcactattccaggtatcgggaaaatagcagtgagcaaaatggacgagaattcctgctctccgggagcttcacttctaatgggggaagcagagcaacacacaagataaaatacacagcatgccagaggttgttaagtgccaaggaggaaaagtggagaaggtggaggggaagggaagggctggtgggcagagggatatgcctactgctgaggaagctcccaccatgaaggtgacatttgcaaacaaacctgaaggaggtggaagactggccaagcagagacctccgggaagaggggctaggcccagacccaagcatgagggtggccagagtgttctgggaacacgaagaccagcgctgctgcaggtgggaggggatgtggggaagataagatgagacagagtaagggtgtgttggggggtgacagattatggagggccccagaggccatcctgaggatacgggagccattctctgagcagagaagtgacataatccaatttcagtttctgcagggtccttctgggctctaggctgagagtggactgagggatgagggtggagtcaggggcatggattaggaggctatggctagtccaggcaagggggatggcagtctaaatcagggcagcagcagagtcaggttttggaaatgttttgaaaatagagccagtaggatttgccaacattggcaaagattggatgtgaggtgccagaccaagtgttgtcctcagcaactgggaaaaaagagttaacgttctgcattaggctgttccagcattgccataaagaaataccagagactgggaagtctataaagaacagaggtttaattggctcacggttctgcaggctgtacaggaagcatggtgctggcatctgctttccttctggggaggcctcaggaagcttccaatcatggtggaaggcagagggagagtgggcatgtcacatggccagagcaggagcaagacagcaaggggggaggtgccacacacttttaaacaaccagatctcatgagaactctctctctatctgcaggatggcaccaagagagatggtgctaaaccattcatgagaaatctgcccccatgatacaatcgcctcccaccaggccccacctccaacattggggattacagtgaacatgaggtctgagtggggacacagatacaaaccatatcatgttccctgagataggatggctgggggttgggggtgaacagtatttgggagggaaaatcagggactctgttttggacacaatccattggagttgcaggtagacgttccagtggagaagacaagtggctggctggctctctgagcctggagttgagggggtgatgtgggctggagattggactttggcatcatcagtgttggtgaggcagctacaatcatgactctggatgagctcattgatgggggcagcaagtgtggacagagaagcaggaggtctgaagactgaggtctgaggtgtttggggagaagaggaggaacctgcaaaggagatagggagcaagcaaggaggcaggaggagagccgggcaggtgggctgcagccaagcaaggagagggggaggaggaaggggggaaggggaaaggcggggagtgggaagagggtaggagggggaggaggagagggggaagaggagagcagggggagtaggggtaggaggagaaggggaggaaggggaggaggagggggggaagggggtgagggagaggaaggggaggaaaggaggggtaaggggggaggaggagaggggaagaggggagaaggagtgaaatatacctgtcgtgggatttgacctatattagagaatcactgtgcagtgcaccaagtggcactggagaagtcatccccgaaataaattggattgtgtgacaagagatgggttcagcagatgcaacagacagggaggagggaaactggaccagccttggctgtggattggctgcgcgatcttggacaaatcacccatcatgttttccttccgtgttacgtggaaatgtctctgatatctactgcccttacctcacagagtaaagacccaaaggagatgtcatgaaagcattttgaaatgctgctgaacactcagcacagtggctggcacagagtgggtagaactcaatggttggaaaatgtacttggctgttattgtgcctttttcatgaaaatatgaaaagctaaataaacctgaaacatgttggggactgagtgaggggagatgagcacgttctgagagtcctaggaccatgcactctcagagtgcctttgctattgtttcgcctcccgtcctacagaggaagggcttaggtttgctgtgaatttcccccttgcctaccagcattgcgccaattaaggtttctacttcaccgcacgtttcagccaaggatgtcaagggaatccactgctgctccagtgagacaaataacatatccagcatcaacactgccatcatcattagcatcattgtggccattaggatggttggcaaggcaataggttggcactactgatgggcagcaccattagtcttcttagtgatttttcaaaatggacagtctggagctaaaagcgtgagccctggaggagctcatttcatcagacctgctgcaggcaaacactcttctcttcatacctttcccgcctgtacgtgtggggtgatgcctgtcttgggaggaaatatagatgcagtgcctagatattccaaagcccaggttcggaatctgtgttccctttgttttttgatatttcccctcctttcctcctgccctttagatcttgtgcatttgtgggtttttccctttctgctcagctctgatcacttatttgcttttgtttttggagagctgcgtcctctctttactcacccacctgcttcattagagattgctactcacctgcagtatccatgctcaccttcttccacgataattgaaagagtgtccggcacacggctgtctacttaaaaactgctttctctagtatcccttgcagcctggtgtggtcatgggactgatttctgcaagaagagtttgagcttcagtgtggtgtgacctctggacctttgaaaagaggggtttattccttccattctcccacctttctcttccttcctccttgttggagtgtggctatcatggtgatggtgaaccatcttggaccacatggatgagggccacacactcaggatgctggagcaacaaggtggaaggtacctgggtctcgactgcccacccttgtgaaaggtaaatgcagttccatcttatctgaaccctagtattttgaggttctgttagaattgctgcacctgtattctaactaataccttctttaggctctttgacccacttgccagattgcaggttgcaggaagacagaacatggttttgctcaccattaggtcatcagggctggcacagattgctcaacacataataaatacttgttggaagtgttaatgagttatggttttactctggtatctggacttctgctttccaaaggatgagtggcccttgacgcattgttcccttgggcaactgcagcctctgtcatgggccaagtatggaatgtccctgggaaataaaatctcagaggaagagagctcctgcccagccgaaattctccctggaattgtgagcctccaattaggctagaagatacagtcttcccatctgttgtagaaacagaaagttatttagagtataaaacaatctcccggcttcatgtgtgaagcctatttgagagtcagagggttccagcagagggaggaggaacatcagctacacctggagctctggggatgaaagaacccatgagggcctcatagattatagggctctgactcctccagggaaagatgatccagtgttctggcctatcttggcctgtggttctttgtgatccatggagtgagagtgtccacaatcgcctgctgtgtggtatttccctgacttgagcctttgctcataaccagcatagcccacaaacaccagccgtatccctcaattcctgacttctgctttcctgtctttacagaagaaccccagctgtgctaatggtcctgtaacctctcagctcagggccatgagaccttctctctgcatgaatctcgcctcctctgcaccccacacttccacaccacttcctcatataacgtgttatctgactacacaaccctggaaatgatgttcctcctgatgtgttcccaagcattcttgctattctgcttcctctagaagccagggaactttagctgaccaggtctgtgtcttgggcacctgccttggtgagcgacctctgagaatttctcactaaacatttgttgaatgaactaggagatatataagggaatgcctcttctgcctaccatgagcatggccttaagtgttatctttgttgcttggccaagtcatggccttgagtcccaagtgaggtgcccagcccttattcctgatcaataaatacttttagactcctgattattctcttgcttgcttgcttgcttgctaatctctaatagattagatctattccctaatctaattctctgatcttcctcctgaaacttggctccatattgagttccttgccctatatccgtacttgcacggccgctatttgccacccagagtccctgtgctggcaaattcaacacccggagcattatcattttggtgcaattcctgagcacagcttgctgactcttcagtacttattgtttctatctggaatacaagagggagtatattatgaggatgatggtaaacccagatcatggtgctcagagcagatctgaaactctggcagcgtaacacctctctccagcatggacagataagggtgattattatttaattggacttttcattttgagagaaattgtaggttcacatgcaaatgtaagaaatgatgtggagacctatgtaccttttatacagtttctcccaaaggtaataccttcaaaactattgtatgatttcacaaacaggacactgacattgatagagtccagattcagaacatgtccgtcatcaccaaggtccctcatgttgcccttttgtggccgcacctgcgtcctcttactctccccatctctgccccatctttaactcctgacaactactaaactgttctttgtataactactaaactgttctttgtataactactaaactgttctttgtataactaaagttataattttgtcatgtcaagaatttcatatgaatggaattacacagcatgcaaccttgacttttcttactcagcacaaccgtctggaggttcacccaggttgtggcatgtgtcaatagttttctcttttgttgctgagtagtattccataatagagatgtactgcagtttgtttaaccactcaccttccacctgaagggcagctggttttttccactttggggggattacaaacaaagctgctgcagacattcacatgtgggtttttgtgggaacctaagttttttgtgtttttttttttttttttcctgggatgaatgctcaggagtgcatgccaggttgcacagaccttgcatgtttagttttataagaaactgtcagactgttttctagagtgattgcaccattttacattctcaccaacaatgtatgagggatccagtttctccacatccttgccagcatttgtggttgtcactcttttagccattcaatagtcatgtaatgatatctcattgtggttgtaatttgtattttcctaatggctaatgattttaaattacctcttcatatgcttatttgccacctgtatattttcctcttcagttaaatatctcttcatgtcttttctcatttcttcaaatttaaaaattcttatttatttattttttattttttttactgtggagttttgagagttctttctatattctacatactagtcctttgtcagataggcagtttgcaagtattttctcccagtctgtagcttgacttttcatcctcttaacagggtctttcatagagcaaatgtttaactttgatgaagtctaatttaaccatttttcctcttatggctcatgcttttggcatcaagtctaagaattccttgcctggccctagctttcaaatattttctctttttttctctataagttttatcgttttatgttttacatgtaaatccatgatcaatttggagttaatttctgcatgaagcgtgagactagattgaggtttatttatttattttttgcttatgaatatcgattgcttccataccatttgttgaaaagggtatctttcctccattgaattgcctttgtacccttatctaaagtcagttggaaattttgcgtgggcctatttctattaacttccactggtctgtgtatctatcccttcactaatagcatgtagccttgatcactgtagctatacagtaaatcttgacattaggtagactaatctatcccatttcatttttctttttcaaaattgttttagctattctagtttctctgccattttatatacatttaggataatcttgtctagatctatgcaataatattgctgggattttgtttgcagttatattgacccatatatcaagatggggagaattgacatctttactgttgagtcttctgattcatgaatttgtaatgcttcttcatgtattttagctcttatttggtttcttttgtaggaattttaagcacacaagtactgcacatattttgttagatttacacctacgtatttcatttctcttgagtgactgcaaatggcattgcatttgtaattttggtgtccacttgttcattgcagtatacagaaatagaattgagttcatgtgtttatctcttattctgtaacattgctgaactcattagttctagggttttttttttggtttgttttatagattctttgggattgtctatgttcacaatcatagggatggttttatttcttcctttccaaactatctgcttttattttattttcttattttattgcactggcagaacttccagtaggaagttgaataggagtggtagagtggtcattcttgcctctccttgatcttatgtggaaagcattcagcctttcatcatcaagtataatgttagctatagggttttatagatgctttttagtaagttgaggaagtccccctctattcctatttttctgagaggttttctaatgaatgggtgttgaattttgtcaaatggggcaagagggtggtaattcttcattattccttactgtaattagtctgtcaatgttaatgagcatgctattattaagcacctattggatgttcagtgttgtgctaggccctgtgagacatataggaacctaaaaatttgagccttgccctcaagcactaaggaaacacactttctaaaccacaatttagcatataccataagtgctgcagaaggccccaggcagcggaggccagtgttgccctggctagaaggtgtcacttaggttggcctttgggctggagtagaacctagatacacaagagaggggagtgaattagagaaaattcaacggcctaaaattctattttctaacaaggacaatggtaagttgataattagtaggatagagatagcttttgattaatgaagttggattatctctattctgtggattatccctgacaaatgcttaatcctgaacttcctccctttttgagcatttgggctctcttttctgccatccgtcaacatgttcaggggaatgcaaactaatattactattagctaaagaaaaacataattaaggagggcaatctgctgtccctaaattgtatcatcttttccaaactaaatatgagtgatattggtactatcttttgtttggagagatccacaccacttctctccctcttaaggctcaagaagaattgactgtgaccatgatatacacaatacatttattaagctgtctctctaacaaggtagctaaacacttgggaagtaagagtaatgccttagagaatttggaacccatgacatctgattcattggtattgtccatatttgtacatgtttactctaatataaagtaataatataatagtgctgtcatttgcaaaattaaaaatcctggcacattactcatgggtcatgctttgggttgtcattctaacgggtttggtggatttgtatagatctggtcctctatctcactttgtcctgctggtgaccagtggctcctcttggaggcagacggccagggttaagggtggaatctgaggccgtgagggagagtgaaattaactgctcccttcacaagggaattgaacccctgaccttcacctcattagcacagcactccaatgcagcaattcctaacctcaattttatatcaccccagggtgtctccacttatctcaagcgggagctgcagaattcctccaacaaaattaattttaattcaccttaatttaaacattaaatacggactatgaggcagcaacttgcaggagtggggaagaatggctgttgttaataaatcccaccaccacaatgcactgttatccaaacaccccaaaacaccctctcgaacccactgagccaaacagtgtggggaggaagaagtctataagtaagcagcaggcatggaaggcttttaaattgcgggggaagcaacacccaaccctaccaaacatctgcatttcatagagactgtttcatgtggtcagctggggtgcactctgacattcactgggccagatggacatatttcagctcccgtccagccagcccatccctttttcctcctagggactgtgatgctttgcatagtcccaggagtttgctgcaggaacattttgtgatttactaagaaaataaattggtctttgttgctggggctttctcctgggtcaatacaaaagatttatcacctccatgccggcccacggagaggttggctcaaaggattctctggccactggcttattctggagacaagcagagtcccagcagaacctttgcagggcaggccagcagcctgagtgtaaggcaggggaagtaaccgtaggaatcagttattgatgaacatccttaaaactctgtttgtttgtttgtttgtttgttttgagatggagtctcactctgtcgcccaggctggagtgcagtgacgcgatctcggctcactgcaagctcctccttccaggttcacaccattctgccacctcagcctcccgagtagctgggactacaggcgcccgccaccatggccagctaattcttttttgtgtttttagtagagactgggtttcaccgtgttagccaggatggtcttgatctcctgacctcatgatccaccggccttggcctcccaaagtgctgggattacaggcgtgggccaccgcgcccggccgaacatccttaaaactcttcatggtcttttactgataacaacatccacatgcattttttaaaggagaataagcatagttccttaccctggcagtgcactttatataatttgtcaaagagtttcacatgcattgtatctcaattgttttctacctacccagaattaccaacttcattttattgaagagcaaatagacttggaaaagttaaatgccttgcccaaggtcgcatagctagtaaatcatggttgtagcaccagatcccatgtcttctcatatactgcactcttttctctatactaatcttatcttggtttattatcaacatccatttgcttttggcagggaagggtccagaatcttcattttacagaacaacgaattgaggtaagtaagcgttttgggtcctgcctctttttctgctggcaccatgtgcctttcttgctgaagggcaaggagttcttttgcaggcacactcatttctgctctcagaggccaggctctcaaccatcatcatcagtgccatcctgctcattgggccccaccctgccctctgtgtccagtgggggcttacatctgtgatttctgggcagtgagggggtcatacgtgaacagttccttcgcatcctcttaaaattgctctttcagctccataagtttcaactagtcaaaacactctccttcacacttcttcaaagatgagcatttgttctacatatttttttgtagtcatattctgcgagtgcacactttccctcttgggtccttagacacacccttttccaggcatgattcacttcctcaagctccgttctggacacatacatctggtgccacctggaagagggcttatcaggtcctcccacctggaatacagcttaaccagagttgatttctaaggcatgcaaccaagaaaccagactgatataaatgggatattattgattttatctgcctaaccgagtctataaatttctgaaagccatggaaggaactctattttgttgcattcctcataacatctagaacggtgctttgcatatactgagtgctcaaggcatatttgcagatggtgacgaggatgatttgatgtcgttttaaaggccggacatccaagaggaggtctgttctctacatgtgcatgcacgtacacttacacacactctctgacttgtaagatgccctttgcaagagtccatttgggaaatgcagtgggcccactggaagaaattcaaggccatgggccagctacaccacggaagccctacacccagccaaacgtgctcactggcaagtcaaacccaaaaactgtcatcaaattctgcttcctggcagcccggatccaacaatactctgaaagacaaaagaagcagaaactcaagtgaagatcaccaacgtgtctttttgggcaactagcagattgagcagagggtcagcacagacaccagcagagaagaacattctcctggcaggactctgcctccaaattcggcaccacttcacaggatctcagcctcacaccttatgggatttatttttttaaaaaagatccaacatttgttcctaattattcttagtaaaactgcctttcttgatgtggcacccattacctcattcattcagtcactcattcattcattcaatgaaacccctgtcatccacgctctgggctctttctacagccccacgagatgatcaagaactctggaaaacaggtaagccattatcatcagtgtatatgaaattatcatcagtgtatacgaaatatgaagaaacccaattagatggagatatctcctaccacacattgaaatcagaactcagacaagactcagatgttctaactccaaattctgagcagtggcccctggataaaggattatggagaaatactgaccagaaaaaatactcttaaatggcatattgtggtgttttaaggcaaggttattggtagtgcttgtaactctcaaaatactgttttggaagtttgtagtgattttgcagaacggctttgagttacctctgggtgttatcaatcattggatagttttcagaagaaatccaccttaatttgagttaaataatatgtcatttagccagatttcctcctgcccccaatccccataggagtgagaagccatggcttggggcattatctcagcatcatgggaattgcagagagggtaccacagctttagagtttgaggtgttgagcctgaacaaaaggaaagggtaagaaacttggggtggatagaacgtggaactactatgaagagcttattgcatagaaaaagagaaatttgagtttaaaaaaaaaatggaagaaagtaaagggagcccaaatgggaacagttaccagaggagattccctggaatttgaaggaaccaggttgaaggatggtttcccaatttgaataattataagaatcacctggtactctttttaaaactataagttcctagagccccagtcttagacattgcatttagtgtgtctgggttgaggcccagaaatctgtatttttaacagaaacccaggtgatttttataatcaggaaagatttgggcaatgtctgcatttgaagatgctgtctctcaaaatgaagaaatacctggacaaagccaagtccaagacaggggctctaagtcaaaaaggcaagagcaaaaacaacatgagcctttacaaaatgtgaattggcaaaaaagcagctgtagctcatatttaataacctcccatggcttccaaagaagcagctgggtctgcagagtcctgtttgtgcacaggatgaatggagtctgtgtgccactcgggatgcccccacaatacccacattatcactgaggtgctccagcgaggcattcattatgcactcccctgccacccaaagcctcaggtcaggtttgccttggacactctcccttctcccttctctgaggctgaggggctgcaggggcgggtgcctgaactccctccctctctcagggatgcctcagctctatgggacttcctctggttcacatgattgcattttcctgccttggggcaccctaaaggcctgcctctgggaagcagggtctagaggcatgagcttgtctggacaacagaagctcaatctcagcatcctaaaggcctacctctgggaaggggggggtcacagaggcatgaacttgtctggacaacagaagctcaatctccatctccaagcagttcgatcccccaacactcttggtattaggaggggagcctctgcaagtgtgaggaccgggggcctctaaacagggtttttttctttttctttttttcttgagatggagtcttgctctgttgtccaagctggagtgcagtggtaccatctccactcactgcaacctctgcctcctgggttcaagagatttctggctaatttttgtatttttagtagagacggggtttcaccatgttggccaggctggtctcaaactcctgacctcaagtgatctgcccacctcggtctcccaaagtgctagtattaaaggcgtgagccaccacaccaagccctaaacacagcctgaggctggtatcccaggaggccttgaaaaatctcaggtttgctgctgacaggtgtgccaggaagagacctggctgctgtctgcaagtggccaaaccctgataatcccggaaataaacaataaaataaactcctcaatggtgattataaagtactattgtttatcagccaggacctgtgctaagcttttcacctacattatttcatttatatttcagagcagtcctttgaagcagtcatgtttatatcagttttatggatgaggtcagagacttctgctggttaagtaccttgccactatcacacagctagctagtaaataaactttaaaaaattgaagtattatgtacataaagacaggcatagtgtacaactaagtgggttatcataaaagtgaacatacctgtgtaaccatccacccaaatcaagagctagactattaccagcctcagaaaaatcccagaccctctccaataacctcctcttccccaatggtgaccatttttgtcaccgagtattagatggctagtttgtgaattttataaaaacagaattctacattatatgttctttttgtctgacttttttctccactcagtatgacatctgtaatgctgatctaatgtcattcatgtacaagtagtttggtcatttttaatgctataaagatgttcatagtatgaatgtatcacaatttatttatacatttttcattttgctggttatttgagtagattttaattttgccccatgacaaataatgctacttggaatgttcttggatagttgacccttgaacaatgagggtcggagcagtaaaaaattcatgtataacttttggctctcccaaacttaactagtaatagcttactattgaccagaacccttactgatgacataaataattgattaacacatattttgaatgtatatactgtattcttacagtaaagtgagctagaaaatagaaaatacttttaagaaaattataagaatgagaaaatatatttactattcattaagtaaaagtgaatcatcataaaggtcttcatcctcaccgtcttcacattgagtaggctgacgaggaggaggaagaggaggggttggtcttgtctcagggatggcagaggtggaggaaaatctgtgtataagtggacccacgcagttcaaacccatgttgctcaagggtcacctgtacatgtgtcttggtgtacatatttcggcataggatataccaagaaatgtaattgatgggtcataaggtgtgtggattttcagctttagtagatactgtttacatagttttgcaaagtggctgtaccagttcactttcagctatgagagtcctgggggatccacatcctcaccaacacttgatactgttggtctctttttacttttgccatcctgatgaatgtgtttcagtttgcatttccctgatgactaatgaaattgagcagcttttcaaatgctattggccatttggatatctactggcttattcaggtctcttgcctgtttttctactgggttttctgtctttccaggtgatttgtaggagttctttatattttccggttatgaatcatttgtcatttatatggattgtaaacgtcttctctatggcttttcttttcattcttaatagtatcttttggtgaaaagaagactcaaattttaatgtagtccaatttttcaatgttttcttttttgattctgtttttgtttctgttatatataagtacaactgactttgtatattgatatttcaatccaagaaccttgctgaatttacttattaattctgttagtttttctataaattattttgtattttctgcatatgcagtgatatagtctgtcaataatggcagttttttttctttctatttcttaaaattttatttgttttcttgctttactgcaaaggctaggacctccaaaacaataatgaatagaagtggtgatagataggaagcatctttcttttattctcagtattaggggaaaagtatcaatatttgaacatttatatgatatttgctggagggtttttttgtagatactctatcatgttaaggcatttcccttttagtcgtactttcctaaatacttcttttttccttttactatcgccaggggttgaattttatcaaatgccttttctgaatctattgagctgatcaacgattttcttctttattctgttactgtggtaaattacatagactgatttccgaacactgaaataatcttgcatttctggaaaaaaatatcatcttgtttgtgatgtattgtcctgtttatatattgctgaattcagtttgataacattttgtttaggattagcatccatgttcaggagaaagaaatcaccattttctttccttgtcaggtattaaggttataaagctctcaaaaatgagtcaagaagtcatttttattttctagaagagcttttgtaaagactgatgttatttcatctttaaaggttttgaagaattcactgatgaagccatctgggcctggaggtttgtttttgtttttgttttggtggaaaggtttttcattatggattttatttctttaataggtacaaggctattatatcagatattctttttttatttgggtcagttttaataagttgtgttttccaaagaatttgtctatttcacctagatttaaacatttatcatcataaattggttctgaacagctttttgtcttatttaggagccacagattctattgttagggcttcctttccattcctgataatatttgggactcttcttaaaaaaaattaatcttatgggcttatcggttgtattaatctcttttgttgtttgtttgtttgtttgagatggagtttcgctcttgttgcccaggctggagtgcaatggcgtgatcttggttcactgcaacctcagcctcccaggttcaagcgattctcctgcctcagcctcccaggtagctgggattacaggcgcctgccaccatgcctggctacttttttgtttttttagcagatttctccatgtcggtcaggctggtctcaaactcctgacctcaggtgatccgccccaccttggcctcccaaagtgctgggattacaggcatgagccacagcacctgtccctgtatttgtcttttttaaagacttgtttttatttttattttttcactttgttggttttctttgttgtattattgttttctactttattaattcctgctatttattatttccattcttatgctatcttaggatttaatatgctgtttttttattaaaatcttgagatggaaacttagttcattgtttcttcatcttttcttcttttcttgtaaagcattcaaggttttaaatttctcttaagcattctttggctgcatcccttacattttgatatgttttagttttattacctttttattgaaatatttcctaatttccacggtaattcttattttgactcatgggttgtttagatatgtattagttcattttacatcaccttaatccgaccaagaactgagctctttaaagatggttcaggctttctgcaggctgagttcttcctggatcacccctttgtggggagtctcaacagaagaccagtggtatttaacccagctcttcctccttgctgggctctgaattcctttctgtgcctcagccccatgagagtcctggcaactctgctcaacttctcagtttccgagccactgctggggaatccatgcacgccaaggagaaaagtggctggcacctctccgctcacgccttgtttctgggatcttagtgccttagtttctcattgcgttagtagtttttttttttttaaattcttattcatttatttaggagacagaggtcttgctatgttgctcaggctggcctcaaactcctgggctcaagtgaccctcccacctcagcctcctgagtagcagggactacaggctactattagctggtggtttttgatgccttcaaatagatttgaaaaagatgttttgtccacattatccagtgttcttggcacgaagggcgtctgataagccaatctatccttaccaccaggggacatcccctggaaccaggatttaggcacaggtctgtgcacacccagactccagagcccacaccgctgcgtggcagggggagttgccatgttggagtacaggccgccaaatgcggagtagaaaaggaatgtgaagccctcttgctctccagctctcttcttcatcatcttcattattctggatctagtcaagcattgccatttatctaatctcagttctaaaatgtgttgaacacaaattttctagtttcttagtaaaattaatcttttaaatcacttactttctaacggttgttcacagggcatctgggacctctttttcaagttcaccttctcctggtctgaaaccaaaatgaaaacaaatagaatccaagtgtgctgtagctcctgacatccctccgtgggctccgccagcccctgcatggaagcctccacatgggttcaccaggctgttcttcgggctctcccaaagtggctgcttttccgtcaatatgaatggcatgactggccacatctcccttttttcttcgggtgccaggaagcctggactgttgagctaactttacggtccaaccatagcaactatgtcagtgtgcagataactgaaggtgcctttccctccctggcttggcttctccctcttacttctcttcccaagctctcaatttgctttatttttgtatattttaccacgatattgtctctctgtgtgtctttatataaaacttgagttattccagttctgccaatctgtgtaatcacttggcatttttatttgtgttcataattttcagccatggagacatttgaaagacaacaaaatcgatcctggagaaacagagatgtgggcactattgcaatttatagaatttattgtaaaattggactttgatgaatctttgccatacatattctgttgcttaagattttttgtaacaatttatgtgtctattgctttatgtgaaagacgcttttcaaaattaaaatcagtaaacagtgttctgtgattaaccaggaacaaaagtagatggacaactgctcaatgaacatgaaacgatgaagatcaatttttcttctaggtcatggacaaattaaagtagttaagtgttaaaaacagagaccatgatgtcattcctcatgactacaatagaccaatatttaactctaagcgtatttcctttaaaaaaaaaaaaagttaactacaaaaatgtagttaaaggtgctaatctactacttttttggtactgtaatatttactgtattatttatttttctattttatgggcataaccatccacagaagggtcagtaagagagaaatatcactgctttcctcttctatccattatttttgttgtttcgtttcatggctactactaaaaataatgttgtcacagagaagcaaggtgataaaaggattctctctgggggtcaatccatgaagaaagctggagaaatatctgctgaacagagttcatggcttcatgttctatctgagcaagtctcatcctgcagtcagctctcttgaggctgagccaggtctttgcacacctttcctctggctgatgcttttaaattccctctgtcttcgtctctgctattgagttcggtctcctccgtgagtcccccacggggcctggtgaggacaggctctgtgggagcagctttctgttttgagcctgtgatgtctggccaaggagcgcctgtcagctgcttgggctccatctcagcccagagacgtcgtgctgtgtggtcttaaagcaggtcacttcacctctcggtatctctctctgtaaaacccagataataatacttcccaaataaagaaagggttttctttaagccctttgagctcctcagatggagcgcaccacagaaatgccaaatgcggcattgtgatccgcgctgcctccatgtgattaggtaatgtgagattgtggttcattatgctttgtctggaatgaatgcgagccctgccacaaagcactgggaactctcagttacacagaaaccccatggtaagcttggattggcttacacttaaataaagcacaccagaaaagagcagtagttttgacgaacccagctctgaattaacactcatttgatttcttctgctgagtgcgggcgataagtaagagatgacccagttacaggtgcggggggcacaaccaacactgaggtgactgagtcgggggaagggcagcccctctgcaaaatgcttcaggctcccaaggaggcaggcccagagtgggcaggtctggacttactgctgtacagacaagggggaaattcaatagctaccatttattgagtttctgctaggtgccaggaactctgcaatgtatgccattcttctaaaccctccagacaacggtattaaaccatattaatattctgaaaaccaaaacaaacacccactacacttgacacatttttttttgtaccataatgaaagcctatgtgtttgggcccacagtttcagccaggattttgacctggggcctcctcactgatcctgaggctttaagaccacacagcatgggtctgcgaattgcaaatgggaggcttacttttcccattcttatccaagcctccagaagtggctctggagctggatccagcctcctttcttacgaagccttggatacatcccacttagcttgacaaacttttaccggaattctctgatcccatttcacagctgttgcaaaggtagggtcttggttgtgtcttccttcaagctgcttatgaaccaggggtggagactaggaagtaaggaaccctggaatcagagaagtcaggagcaagcatcttgttggcttgaggttctccaggcaccataaaccaagtagtgcgcatactaagaaaacaagctggacaacaagaggagagcaggagggtccttaggattggctgcttgtaccatggcccccagtggctcagtagagacaaggggaatcccaggtaagtagactccttcgctccccagagaggaatctattgtgtcaattgctgggaaacacgctcagttgaactgaccctctatagccgtatgtgcatgtggaatccattgttagggaaaccatggtgagaagggaagtgagatgctctggatgggtgctgagctgagtgctgatggaacagaccttccagaaaaggttgcatattatccaaggaaatatcattgcctggagagtcctaggctgacttgctctcttgggagctgatgtttagggaatgggagaagcagctggtttaaagcatcaaacaatgaaatgaacttcagaatctgccaaatcctaaacatttcttgctaagcaccattttttctgtattgtgaacccatctgtgcttcaaaagcaattttgtttaaatggcttcttccccttactcctaatccttgggaagctgtaatacacaggtggtaaaggggactccccaagagatgctcactaggactgctgtgagccagatactgggctaacactgcatagcaccgagggtgtgggagatcagaagtcaggagcctgcattctcaggggagggactggatccctgcaaggaaacaaagtgtggtgtgtgtggcttcatgatccactggcctaggtctaatagcggatctttttgcaaatttatttatttttcttttcttttcttttcttttcttttttcttttcttttcttttcttttcttttcttttcttttcttttcttttctttcttccttccttccttctttccttccttcccttcttttttctttctttctttccttgcttttttttttttttgatggagttttggtcttgtcacccaggctggagtgcagtggtgtgatcttggctcactgcaacctctgcctcccaggttcaagcgattctcctgtctcagtctcctgagtagtggggactacaggcaggcaacaccaagcctggctaattttgtatatttggtagagacagggtttcaccatgttggccaggctagtctcaaactcctgacttcaggtgatcctgaccttggcttcccaaagtgctaggattccaggcgtgagccaccgcacctggcttgcaaatttctatttctaattgagccagtatttcttcccaaaggttcactggaaaatcactgacatgaagaagattgattaataggaaaaaaggcatacacatttatttaacgtgtatacacaggagccttcagaatgaagacccaaagatagaggggaaattgtccacttttacacttaggttcaagacagtatggatagtcacatagaaatatgactggacaaaaagggtctgatggaatgctagactagactgagtggaaagcgcagcaaggcctgtctgcctagattcttccaggcatccatgcagcattccttccttctgggtatgggacaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagcaaactttcagcaaacaattcattgtgatggcaatgagctatctgagaagtaaactgacacaatgatttcatttataatagcacctgtaaggataatatgcctgggaataaatttgttcaagaaggtgcagtacttgtacacagacaactacagaacattgttcgaggagactaaggaagacctaaatcaatggaaagacatcttgtgtccacgggttggaagttgtaacatggttaagataaaaatacaactcaaagcaatccacagactcaatacaatcctatcaaaaagtggctttttttacaggaatgcctgagaagaacttcatgttcctaaaaaacagcaagtgtccccccaaaacaaaagcaatcttgaaatgcaagaaggaacgttctctattccaaaggtctttaactgctctcagtaatacgtggtaatcttcaatatacaggctttcacacctttttttttttcttcttttgtttctagacacgatctcactctttcactcaggctggagtacagtggcaagatcacacagctcactgcagcatggaattctcaggccgatgacatcctagggcctcatccactgagtacctgggactacaggctcacaccaccacagccggataatttttctgattttcagtagagatgaggtctcactatgttgcctaagctagtttcaagcttctgagctcaagcgaccctcctgccacggccttcctaagcgctaggatttgaagctgagcctggctggctttcacatctttgctatgtagtttatatttcttggtgttattgtaaatgtttatgaaaggaatcttttaaaaattttgtattaaaattatatatttaaggaattacatatattatatatatttaaggaatacaacctgaggactacatatacatatacacatacacatacacatacatacacatacacatacacatacacatacacatatacatatacatatacatatacatatacatatacatatacatatacatatacgtatactatacataatgaactaatgcctactaggtgaggggctgccttgtgagcaaacccaaagtccttggctcacaaagccttgtctagaaagatggagggatcagcaaagtgggcacacagcaggttctgtctttagtgcgggcacctgcccactcgggtctctggcaatcctgaccaggcttcatgatgggtgaggtgagctaggaatgggaaagtggatgacctcagatccagagactgcagttgtcacctggggacctggcatgtgcgtggaggagtctcccactgatttggccctggatcaatgcccaaacatgcacaaggacaggactgttggcctcaatgttttaggagccaccagtcttctaaagagggtttgtggtggggaagaatgttcaacaaaacagaagagttatgggtactctagcttggcaacagagaatacttccttgtgctactaaatgacaatatttgacaattatggatgacataattgagcaacagctttcactgtttaacaagcagggtctctggaacactaggttagtgctgtcggaagttgactgaaaagtcggtggtttgagcccatccagtcgcattaatgtttctagctgatgtgaccttccatctgaagagtctcttccttggaccaaatatatcttcaagcttctcctcttcttgtctcttgtctattttccaaggtgcctctttgttgcttgaggcaaaaaaagttcattattaatccacacccagcaaacatctacccttacttatcccggtttttagagttttgagtttgtttgttttctcagcttctcatatttggaatactgggaattcctaaagtggagaacaacagaacctgaatcacacctatggtgaagccacaggccctgggtgaaaaacctaatctgctcgcgtttaaagataaacccattaattttctgtgcttccatttctatctgtctaatgggctaaatcagaacacttaatttgtccaatgtttaaacgagcagtgcaggaaaagcgtggagccaatgcctgtcacgtagcaattggtcaacacgcatgagctcctatcagcgtcacggcctccagcatttccatcaggctttgatctttgaaacgtccttcctgatatgaatgggtcattcttcaaacattctctaaccgatggccatgacattgttccaatgtgtattattacaaatacaactgcagagaccagactgacacatgtatctgtcgtgcatcacttgtctatttctccgtagatacctggagatggaattgtcagaccaaagtatttatacatttctgattttgctaatttctatccaaattactatgaaaagaagctgtaacaagtcatacttttaatattttatgagaattctttttttctccatcttctggccaaaactgggaagtacttgcctaccatttcctctgaacttacttttgccaacatttctgtagtcacacagtgggatcacattgcatgcatgacatcaaactcaaatcctaattgaaaagaggggttcacaggactctataaaaatttatattcaaaatacaaaaatgcaaacatatatgtgtatacaaatacatatatatacacatacatatatgggaaaggaatttttttatttggataccttatcaaagttatatagactggaaaatttgtttagtaaaacagcagtccccttgtgtactcccagagtttcatcacatagaagcaagtatttagttatttatctccttatgtctaaatagatattattcctttttgattttcaagcgtaggcactatctctccttcacatacttgctcatcaccaccacccccaaacatgcctctcactaccttaccctctaacatgtttgtgtcctagtttgagggccaactactacattattataacttgtatatgttattcagagttcagtcacactggatatacatagcaggaaatgaaaggccagtatcttcagggactctctctcaagtggataagcttcagagatttttgtaatctttggtcaccctctccatctttttcctattccgggtaagtactggatctgatgggcccagctcaggtcaggcactctctccttgagaaggggagagcaggacatcttcatgtgtagtaccaagaagacactgtccaaagagggacaggtagttctgagacagaaaagtcaatctggggtatgggtaggcaaaacgaggacacaaaaaaaaacccatgtctgttctgtgaggggagcatgcagtagagggtggattcagagtgggaggggagagttttgagagatatgggccatggatagccctctgtgggctggagccacgcaaggctgttggggtctctcaggggcagggagctgaggagaatctgccctccccaacctgggagactggtgaggggactgtcctggtcaccagacagaaatggggtctgggccagggcagttctggtgggaaagaaagaacaggacatcttctccttaggtaaggctctgagttcaggtcttggtagggagggaggttaccttgggcattggccactgaagatggttggccagatgagcacactgaaatctatgttctataaacttgcagttctagtaaaagaatgactgcagtaaagggtctttaggaagaggaggtggaagacctgatttgggttgggggctccaagaagaatgtctgccttgctgtgcagaagcctgctacacaacctccctggtccccttgctcagtctcccggccagacccccagagtacctgccctgtgcaccctggaagtacacagtgagttcagccaaggcatctccagccgggactcatccctgggcatttctgtggccttgggtgccctggccttctccaggccctgtcttgcaggcaatcgtcctgcaggggaatgggagaaggaggctacttgacagttgactctgagtggctccacaagttcctgacttagctcctagtcacttgcaaacctatatacccccatctcatcccccaaatggtgaaaaagaaactttgccaggactcatgccagacaaatagaacagaaccgttccatagagccaaggtcttaggacatcaataagagatggaaaccacctgctagaaggtgccacagtgggaagcttgttggaagggagcagtcactgaactgtcagggtgaatcctggctcctggccctcacacgccctttctccccttccttccttctctcctccctcctgtctgctctttcccctctctcccctgcatccctcaggtaccttccatgggccctcacccctccttttcagaggctccaaagtgagccctcaaaatacttggtaaccttgggcatttccaaaactggagagatttggccacaccatttttaggagctaggaacgtcctccagagctcttgcctaaatttttctgctgatgagaagagaacaaaagagtttccatctgatctggtcctaaggcaactgctccttggagcagagtctgggcaggaagaagggggttgcccagggccccagacttgcccctcccagctgctgtgctcctctccccttcactgcgggaggctggccagggatcgggaacctctgttctccacagttgctgcgatcccaggcccaaatctaaatattggctgatttaggaggctaagggaggcaattccctggagagaggtgtcaggatctgggacaagagcagcatctggttgccatccacggagaccccaaggacaggaatccagtggtagcctgttggaggggatcccatgacaataaaatgaaacgtgtgcattagaactggagccaagaccaggagctgaaaaaccgcgccgtcctaagggatgaaggaattagggaatcccggaagtaaagtttttcatataggtcatttcttccaaagagacacagggcaatggcccaatgacatgtataaaagaaaactcagggtctaggattgaggggaggcagccttttcagtggaggagacctgtcacctggaggcccagggtcaccctgagaggggaggggtcttgctgggtcgctgggtctaggactccaattgcacacagccagtggcctggacggtgggtgaccatgactggggcaatttcccccattccgcttagggagcaataggaatatcattggcattatacagaaaggtcccactgagacttgaacgctgatcaccgtactcagagtccaaagcgctcaccattacatcatggaacctcacaatagctcgtaactggagggcactgagttcacagagcagccgtagttcccacgcacctctgttcatgtatttcctctgatccctcaagcaacaccgaggaaggtggacctgagatggaggagtcgtcctctttctttctctgccctctcctttgatcaacttttaccatttcctttgcatcttagaaaatgaggcaaaatccagtttgggcttagggccagagaagagcccttgaggcctccctcatggaaaacatactctctcagtttaccagagtttcctgtaccaaggggaaatttctgcaaacagtaatgttatattctttttgccttccctcttttccctttgcccagggaggccagatgattgtcagaacaggacttgggccttcctgggtgcctcgcccccttcctccatgtaataaataatagctgacaccaagcaagtgggattgggaggcagggaagctttcattttctttttgatatacttttatgcatttgcttggttggttatggcaagattttctcaccagaaatggagatttgttggattgaaaataaaaagtaatcagccatgttttacattcaacatttattgaacccctgctgataaagcacttgccagcttcagtgggtctgctagagatgagagtacacaatccctgacttacagataccttgtcccaactaaggcctaggttatctgaaggggagattatcaatggcaaatgcaggctcctcctgtggaaagaaattctgcttcctggagctggtggtctcttctcccaccagttcaaagaagcttctctcgcactgtggatctgccctccctgccccacaaggttagggtatgtgccattggggctcagggcatatgtgggaaattcagacattctgtaacacctgctgtctcttcccacgcaggtgaacccttgctgaagcaggacagcaagcaggtccaggtggacctccacgacctgggctatgagacttgtggtcaaagcaagaatgaggctgaacaggaggaatccaccagtcccggtaagagcacagggtgtggggctcaccttccctccctggagtcagctgtcacatttgggtgctgttggccaattccacacctgacaagtagtggggaagaggaggacaggaggttaataggagaactcttacccaaaatgaggctgagtataagtttgaatttctacaatgagtttgtggcatactgctaataataataataatcatatgaagttctatccaactgattattatagaaatactaaggcctacttagagaccacatgaggttttggaaacatgcaaaccataagttaaaaataattttggtttgcattataaaaggactacaactatagggccacccaccacattcaaaacgagaagagaagaaaaacacagtctctctcattcttgaggaagtgtactgtggcagttaagagaaaagatcctggggtcagacttgttgcttcaaatcccaatttgtaaactttcctatgctccagtttcttcaaatgttaaaatagtaataaaggaactacctaccccatcaggtactaatgtcaattaaatgagtaaattcttataaaatgctttagaacagtgtctggcatcgggtaaaatgctgtggattagttctcattctgactaccactgccccaatacactgatgttaacatgctgatatatttattcaaactcttattttcctttgcctatttttcacacagttataacccaataaacttttaaattatagtaaactttagagagcattaaacttgcagcatgcagaaatagcttgtcctacattcttgtggctatcctaactagataaggccatgttaataatgtcttgagaaacatcagtgtgtgtggaatgaacacaggatgttggaggatttgaattcaggctctgccacgtgctagtttgagtgatctagaacaagctggtttaccacctctctttaagttttggtttccccagtcagtaaaatagagagtggtgaaacctaacttgtgggtataaggaggataagaaatactgtatttgaatgcctagtacagtgtcagggttgaataaagtacgacttcacctttttccctagtaattattatcctcatgaccaaacctgcctcctctcaaaggcagtggccacaacagcacatccaacttttattcaggaagacatctttgtcttttttcagagcatgaggagcacagcagccgcaaggaaatggtcctggtggaggggctgtgctctgagcaggggcgccggggctgaacgctggctagttcctctgagaggaagcccttggagaatgaactagggaagcaggaagagttctgggtatatggaaagtcagaaaacatctgggtcctatgaaaggacatcaaagatctgaaggcccagctgcagaatgccaacaaggtcattcaaaacttcaagagccaggtccagtccctctcagttacaagtgattattcatctagtctggaaagaccctggaagctgagagctcctgacaccctggaggggtcttcacctcatagtgtcactgatgaggatgaggtgtggctgtctgatggcactggggctttctactctccaggacttcaggccaaaaaggacctgaagagtctcatccagagagtatcccagctggaggcccagctcccaaaaaattgactagaagggaagctggctgaggagctgagatcagcctcatggcctgggtaaggatggcactgtctgggcactttctggattgaaaatgtgtaagtttgtgcttggtgtagggtagctcaggcagttggaagaaacaacatgtctgggtattcacaaggacactgatttaaatggtagatataggtctgtggaaaagacaggtaggcaagcaggagggcataggatgatgtcccagtatctgggagataccagatctcagggatttcctcttagggatatatcagtaaagtaatagtacatatggtatagtatagtatagtatagtatagtatagtatagtatagtatagcatagtatagtggtaatactggaatcagactgcctagctctgatgcttactacccatgcaaccttcttaacctttctgagcctttgtcattacctattaaatgaggatgataacagaacccatctcaaagggtggatattaggtttaaatgaattaatacaagtgctggccaggtgtggtggctcatgcctgtaatcccaacattttgggaggctgaggtgggcagaacacccgaggtcaggagttcgagaccaggctacccaacatggtgaaaccctgtctctactaaaaatataaaaattaggtgggcatggtggtgcacccctgtaatcccagctactcaggaggctgaggcaggagaatcgcttgaacctgggaagtggaggatgcagtgagccgagatggtaccactgcaccccagcctgggtgacagagcaagactctgtctcaaaaaaaaaaaaaaattagtacaagtgcttagaatggtgcccagcatacattaagctctcaatgctatttgccatagttatcagtgttattgacactttgtgttgaaaacacagacattcatcttggtatgcgtcctggttatctactgctaagtaagaaccactctaaaacttagtgacttcaaacagtactttattatgcttcatggttctgtggtttgactgggctcagctgggtggctctcacttagggtctcttgttttgggtctcatcagttgatggcatgagagtttatgtgatggccatgattgcaaaatacagtcagccacagtatcacaacacagaagaaattcagacatcaggtggtggttaaaacagaagacatgaaaggtcctatctagacttaggatgagatgagtctaattattcattgagtatctgctgtgaatctctgtgatgctggtgctgtaagggatgtgaaacgcagaactatcttcattctcacagaccttacgatttatctagggacatataattaacatatatagaacagttgaagaacagtggcatggtaaattttttgttttgttttgttttgatacagagtctcactctgtcacccaggctggagtgcagtggtgccatctcggctcactgcaacctctccctcccaggttcaagcaattctcctccctcagcctcccaagtagctgggattacaggcatgtgccaccatgcccagctagtttttttgtgtgtttttagtagaggagggggtttcaccatattggccaggctggtctcgaacttctgaccttgtgatctgcctgcctcagcctcccaaagtgctgggattacaggcgtcagtcaccacgcccggcccatactaaatttttagtgcaataatttatcagggtagaatttactcttaaatacctcctatggcttacgtgccagaattcagtttgggggagttccttagagatgttctcatagaaatctctacagaagccccataacttatcatccaccctttcctcttctgtcctgcattaggaaatatgattccctgattcaggatcagccccgggaactgtcttacctacggcaaaaaatacgagaagggagaggtgtttgttatcttctcacccagcatgcaaaagatacagtaaaatcttttgaggatctcttaaggagcaatgacattgactactacctgggacagagcttccgggagcaactggcccggggaagccagctgacagagaggctcaccagcacactcagcaccagtaggttggccacagggctttggatactctcagtcaccccacagttccagcccctggtggccaccacatctccactgcaactttttaacgtagggtcctgtttctatttcatttcctggggctaatacaggatcaagactgctcaatggggagcatggagaggaacacacagggctggagatgccatggttacaactctagaaacttcaccactcatggaatgtgacctgtggggcaggggcggcatctctctggtgctaagagggagtaggggacatgacatggaagggccttgttataggaggaagagccgtgagctaacaattgcaagacgtcgaggcgctgaggccaaagggtccgtgaggaaacaggcgcagctcgcgcccctcggcctacgggagggagggcaaggagagtcctacggttcctgggaggacgagaagagccaagagccccgacggccggcgccggggaaaaggccccgaggcggggtccgcatccctggaagggcggcgtccaccctcctgagaggcacggggcgcccagggctcggacgctcaaagcccgccggctcctgcagcttctgggagccgaagagtgtcagccgggaggatcccgcacacggcgcttagttctggaactgcatacccaggggaggatgcgggagcccgaagcccgggtatgtgtccccgaagcccgggtgtgggtccccatggttttcgtgttgggggtgggcgcggaacgctaagcctgggcctattgggagccatagtcttcttgatggctggtgcttattgggcttttttcagtcgaatttcgaaatgcagttgaatttcttactttggaaacgataatagaaatggctgacctaagattttcatgatgatattttgccttttttggtgtatatgcagtttctgtggtgtagtggttattatgttcgcttcacatatgaaaggtctctggttcgagactgcgtgggaacatcgtgttttgttttgtttttttgtccctaaatttagtgagtttaatcgaggttgggaaacaaacagaaaagtagttgaacctgtggctacactttagacctcctcaatctagacagatcgttgaccaggctacagtttccactggtctgccagcaagaggcctgcttaatattagctttggttccagaaattccttcaggttctcttcattctcttctatcgcctgtattttcacaggctgacactgaaagtggatgacatcttagtgcatttcctaagggtcccgcttggcttcgctttactctggtaagttgcagatctggctgatttgcaagacaacaaaaacaaaatattttttaaaaaggttctaaatctgcatctggaagtcatagagtcaatattcctaaatcacatgaattatgtgtatacatttgcatgcataccccttccccaaataatcctcagaaaaccggttaagttttagcatctgtgactctgagatgcatatgaggcctttgtaaatttagaagttaagagtagaaagtacaggtttgtattttagaaggagatttgggaataaatatagctctggtggatatagatcatatgttaaggtttgttggccagagctggtttgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatatggagaaaactctggatttgtctcttcagttgaatgtttccagagaaaattgaggaaagaaatctctctactatttgaacttcatcaaaagactaatatgctaatatttgaccgtcaatatttccttaaactagtctactccttacatagctaatacatcaaagcatattaacttaggaaatgggattctcccaaacaatgaaacattgacggcaagcgttcttcatcttttcatatcacatttccttcaaatgctttatacatcttcaagcagacaaataatagtattataatgattacgagactgatcgttactcttttgccaaaaaaaccagcgacaaaagactaacttagtggaccaacctttatttcttcattttctctaccttggttctgtccttttatttcctctttcttctaattctgcttctgctactgatttcctccctggatttgaactttacttacctaaactaccagttaggttaccttcttagaacctctaaggcagcagtttgaggttgacgatggaagatttaggattagaaaaaagaaacgtgaatgaatttctgatgttttattataggggtttgtaatgcaggtagaaagaaggacctttttcagagttaagagtttgatccgacaaatgagctattttgatatttataacgttgtctagtaaaagtttcctgtaaaaacacatttggtttggatgtctttgttagcttttagtcgacacttgaaaaaaccgcttggaacggtttctaagtctttgtggatactcttttctgttatcctccaggcggtagttacgcagaggcattggtggttcagtggtagaattctcgcctcccacgcgggagacccgggttcaattcccggccaatgcaaaagggtctttttcaccccgctgttgctctttatctgtcttttacgctgaaaatcatactgcataacctaatagtgcatttaggggcttggccaccacaaggtaaagtgacgacaacactcacgaaagtagcggcaggagacattcaggagactaactcaggaccccatgcagttgttggactcaaacagcttagcaagctgacaagcatgaagtgtttccggtgagtcactgcagttttcatactggtacctgtgactttcatctattcactggaaggatccctgcaaacccgaagaaccatcaggttcctgattcgcgtgctggaccttgggcttaccgttgagccactatggagaggatcaagaaatgacgctcttggaaggagagaagctgcgggcaggacagtcacctcagaggtccaagaggcgtcagcggcccaaagaaaggggtggtgtgtgggcaagagtctgcgtggagatgaggggagcggcggagactggtccttgcgcagaggtggccagtagaccctcagggctgtaccccagacaccgtgaaccgaatttgctaacatcgtcagcgaccgcggcctccgcgtgttttgtgggcccatcggtgttccccgagaaattccgtgtgtctggcaatgtgtgtcaacaggtgttggcctgaaatttggccgggcacggtggctcacgcctgtaatcccagcgctttgtgaggccgaggcggatggatcgcttgaggtcaagagttcaagaccagcctggctaacatggagaaatcccgtctctactaaaaatacaaaaattagccaaatgtggtggcatgcacctgctattccggctacttgggaggctgaggcaggagaatcgcttgaactcaggaggcggaggttgcagtgagccaagatcgcgctactgcagtccagcctgggcgacagagcgagactccgtcaaaaaaaaaaagaaaaaaaaaaaggagcgaaagaaggcagagatgtcaatgggacaaagagacctcccaggaggcttgttgtagaggcagtggccggatcctgagagatgagattttttatttaattatgtagcagaatggggagagaaagggagaagcgcatgaaagacagaaaagcacgaaaatctgcggacgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgctgcctctcaagggccctttgtctgtagcttccactgatgaaataatgcggttatagtcttttctggtagagaaaacggctgtatcagtggaattttttaaaaacacaaaacgagaacgagtttttaatgagctgacaataaaatctaaactagttgtcatggtctgcaccggcttgcctccattccccatctgctaatttttatgagaacagtaaattattactattatcattatttttgagacgtagtcttgttctgtcacccaggctggagtgtcatggctcaatctcggctcactgcaacctctgtctcccaggttcaagcaatgagaacagtaaagaaactacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatgttttgtgtctggccttttttctgcagttacattcattatactcatgagatatatccatgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgttttttcaccagcgatgacagttgaagtggcaccaaattcttgtcagcatttggtgtacgaactttgttaaatgtagctatgctctcagaccaatctggccaacatggcgaaaccctgtctctactcaaaatacaaaaattagccgggcatggtggcatgcacctgtagtcccagctactccggagggggatgttgcagtgagtcaagatcacagcattgcactccagcttgggtgacagaatgagaccctgtctcagaaaaaaaaaaaaaaaaagtagccatacactggtgagtagttagtgctatctcagtgtggaattaatttgtatttgcctaatgagcaatcctatgaagcatactttcttgtggcttccagcatataagaaactctcctttgcaaaggcctattcaaatattttgccctattttatttggcttagctctatattactgatttacaaaagttctcttgtatattcaagaattgagtctttttttttgactttttttattatactttaagttttagggtacatgtgcacaacgtgcaggtttgttacatatgtatacatgtgccatgttgatgtgctgcacccattaactcgtcacttacattaggtatatctcctgatgctatccctcccccctccccccaccccacaacaggccctggtgtgtgatgttccccttcctgtgtccaagtgttctcattgttcaattcccacctatgagtgagaacatgcagttcttggttttttgtccttgcgatagtttgctgagaacgatggtttccagcttcatccatgtccctacaaaggacatgaactcatcaatttttatggctgcatagtattccatggtgtatatgtgccacattttcttcatctagtctatcattgttggacatttgggttggttccaagtctatgctattgtgaatagtgccgcaataaacatacgtgtgcatgtgtctttatagcagcatgatttataatcctttggcatttataatcatttataataatcatttatttataatcatataaatcaaataaatatataatttatttataatcatttggcttttagcagcatgatttatatacccagtaatgggatggctgggtcaaatggtatttctagttctagatccctgaggaatcaccatactgacttccacaacggttgaactagtttacagtcccaccaacagtgtaaaagtgttcctatttctccacatcctctccagcacctgttgcttcctgactttttgatgatcgccattctaactggtgtgagatggtatctcattgtggttttgatttgcatttccctgatggccgctgatgatgaggattttttcatgtgtcttttggctgcataaatgtcttctgagaagtgtctgttcatatccttcgcccacttgttgatggggttctttgttgttttcttgcaaatttgtttgtgttctttgtagattctgatgaatctacagatgagtagattgcaaaaattttctcccattctgtaggttgcctgttcactgtgatgatagtttcttttgctgcacagaagctcttaagtttaattagatcccatttgtcaattttggcttttgttgccattgcttttgctcttttagacatgaagtccttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcctgatagtgattcttcctacccatgagcgtggaatgttcttccatttgtttgtatcctcttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattttgtatgctgaggagtcatttttaaaataaatatattgcaaatgaattttcccagtcagtgaaaagtctgactgaaagctgtcaactgaaaaatcacacaatttataaatttagaagggagattttattttttataaatggttacagcctgcaaggtggccattcccacagactgggaggcataccctcctgctgaaaccgaaaagtaggtttccagggaggggaggggggaacagggatttatgttgatctggtgggccacatatgcatattcaacagggaataggaggagctctgaatattcatgaagggatcgtgctgcatgcatgctgagtaaacaagcctgttacatgcaacccatgttcactttggggtggagatgacatttaaatacattataattagtccctatgcttcaaaaggggaagcagggacacaaaggcagtcaagtgcacagcctctgtaaaacgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggtgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagcttccaagtactggccaggaactcagtatttaagacttctctggggtctccttggcaaagaagccatctgtccagctagttgggtggcttcagattttaattttagttctgaaagcatttaatttgatgaaattttgccatattttttctttatttttaaagcccgtcatgttctataaaaatctttctactcaggatgtgaatggattctcttaattttatctctctatgagttccagagtttcagttttaatttttaaattgatgacatctaaaattctactcctaaccaaaacatttttgggggtgactaaggacaactccaaaaatcttccataaatggaagtaagacttactccttaaagaactttctgggatcctgagctgcggggcacagtggctttagtgcacctctgctcttaagactattcagaaattgtctttgtgaacccatcaggctgtttcaaaatcagcaatttagggcttgcttgcaacacgcagttaagcagcagctgttttttggatctcatgagtgcctgcatgcatacttccctgggaattttctaaatttgaattctcatggtatttcaagtggcatagttgtctctttcttttgcctacagccacatacataccaccaaatcctgcactccaagcttctccttcctcaccctgaactcccaacctccagttagacaatccacatcttcccacacctgcctcaggctccatcaggccactgtgcctcccgcagcaaccaggccagggggaatctggattcctattacacttctgaggaaggtgatcagggggcgtggaggatgtgggtgggaaggggtgagattgagggcaggagtacactgtggtcttctgtcttctacctcattggcccaggtgctgctcttcctccggttgtctgctttcagccctgtgtagggaatcaggtctgcgccctcatcttcctgactctcattttctgaggaacctgaatggatgagccgtcgctcttgtcccacacattgtgtccaaaggtgccctcctctctacttgctccggtgcctgctctctgagctctgacactcaggctgggatgccgcccagtacagaagctctgcagccctgcagggctctgactgttccacaccagcaggataaaggccacagggcatgctgtggtcgaaaagcattcagaggtgtgggctgaaggcctctctttccacagtccctttgaacaccccatggaagtcagcacccctttgaggaacgaggtggcccaaggcctggcttcacatgcaggccgttgggtcccagtgggtcctctctgtgcctggtatagccaacggcttcatgcatcttacccggtttcctctcctccaccacccaagctcctccttgacccccttgctcagctgttctcaggacagcaagatccccagcccttggaaaagcccatctccagtgcttggggagggagttgggttcaggtcgtctaaccacagaaggacagagaacttgaggcaggaggaaatcccttcccttgctgggtctcttggcacagcccatccaggggtctgggtcagggtccaggtatactctaccctcctataggacctggatttttaggcccccgaggttggtcaacgtggagtctttcccactgttcacctgggaactgaaggaatatcccatggggccctctcttactcattagagacacccagaaaatactccattcagcagaaactgcgtgcagtgtaccagaccactataattataactgcagggtgtggaggtcagacacgttttgtggctattttctctctgtctgtgacttgcttgccttttcactttcttagtggtatcttttgatgagaaggtgtggctaatgttgatgaagtctcatttatcatgtctttcttatatatgtattttttgtgtcctgcttgttggtagggtgatctttgcctaccaacaagtcacaaactatccttgaaatgctttatatctttaacttttacgttttggtgtgtaatgtacctgaaattacttttgtgtgtagtgtgagggagaataacattgttggtctccccacattcatataaaagtccattaattgaaatgatttattttcttttattgaactgcttttattgaaaacccatttattgaccgtatagctgtggatcagtttcaagtctcttaactcagtctgtttatctatttgtcactcctgatgcctcgtctgtaatagcttatagtaaaccttaaagtcagatagtacaagtccttgttcttttttacacattgcaataatttttgaaataggtaataactcataaaaccatcacacacatcaggatatgctgtcacttcatccctttctgacatggtttggccgtgccctcacccaaatctcaacttgaattgtatctcccagaattcccatgtgttgtgggagggacctaggaggaggtaattgaatcatgggggcgggtctttcctgtgctattctcctgatagtgaataagtctcactatctgctgggtttctcaggggtttctgctttggcttcttcctcattttctcttgctgctgccttgtaagaagtgccttttgcctcccgccatgattctgaggcctccccagtcatatggaaatgtaagtccaattaaacctctttttcgtcccggactatgttatgtatttgtcagcagcgtgaaaacggactaatacactctcatttctgagtgggacacatgctgtcactcacatatgctggttgctgacttgtgacggaagattctctattgtaccctctggggacaatacatctccagttgcctgcggggaggatgaacatgcaaaaaatccacaacactcagcacagagtctggatttagtcccattagtctgaatgggactaatgcccttataaaagggacctcggggagctctctcgccctctttctgccccctgaggatacaatgaggaggtggcagtctacaaccagaacaaaaggccctcaccataaacctaccatgtcggcaccttgatctcggacttccaacctccggaactgtgagaaatcaatttctgttgtgaatcagccacccagtttatgtatggtacagtgttagagaagcccgaactaagacacagatggaatcccatggagagtctctaatttgctaagctggtcatcaggcgggatgttgccagttagaaacaggaagagctgacattttgtgtatatgaaagaagatagtggacaggcccattgtgtcggctttgtctgccttggcaaactggagacggaaactcgattcaccatcgccagccacgggaggactgggaggacctccagaggaggttaggttgacttcatggtaactttagatcctgaaacctcccaggatatttcttgtcttccctttgatcgctcttccgcctacccaacaggacaggactcgacgcctttctttcctggcagcaagaggtccgttgcggacaagaccaaagtgagcagctggtttcccctacgtgtccttccgggcctgggcgtctctggagctcaggctgacccgagacctgactcccggccagtgggaccagcaggagcctggaagagcgcgcccaccggggtggaggttggtcgccgggggtcgagaaccgcagtcaaaccctcttcttccccgggcaccgcgcacctgcccccggggatgccgaaggaagtggcccataaagcttctctgcaaccgaaagaggcctgaagctccaggagggccgagaggagcctcgttgagcgaacccagccctctgcctggctggccctggtcaacaggctcggaagaggctgatttggaggacagaacggaagaaaagacctaaaggtttcgaatctcatgatgtagagatgttaaaagcctccaatcctaaggtctgactgtgcgggggagcgagggggtctcaagctggatggacccctgagccttcatctggagagtcctctgcacaagctcagacagcaggacaacgcgcatcagtggttctcaagagggggcaacttcgcccttacacgcctctcacctccacgctgggacactaggtcacgaatgggggaagcggggagggagaatgctaaccccctggcatgtatctagtcagcagaggcgacggctgctgctaaacaccttacaatccacgggagggcccctcccctaccccgaagtagccattccgcagaggtggagagactctcgtgtagctcaatgcccacgcacttagccgatgggaaattacgaattgatgaccagttggctcttggatctgaggaaaaaactccagagtcagagggaactctcgaagttttgcccggagcaaacggaagggtggctttgccatcgcctaagatgggaaaatggcaggtgtcacaggttgcaggggaaggtcggagaccagctgagggccccggagccttcctggaaagagtttcccatccagcccgtctcggtttccgcatccgtctgattccttatgatgttgagggtgctggcgtctgggtcctttatgatgcagagggtgcccccgtctcaccctgggcgcctccgcgctcccgcctcctcctggcaacctggtgcgcggctccggacctggcgacccacgaccggctggtcacttgctgccacctcgcaaaggcgcatctctagttcagtggtgagctgcggccgggtcgctgcaactcgctccaggcctccggactcgtggcctcggtgtccctcgcggagccctcggtgtgtcgcttgcaggctctttttttgaagaaagcagggagggaatggccttgtgagagactccaggagcaaagagcgaccctcacaaggcccaagtcctcccagagctcagggaagctgtcgcttctgacagaagaagggagacaaagctccctcctgtgtgtccctggtggtctagtggctaggattcggcgctttcaccgccgcggcccgggttcgattcccggccagggaattgttttacactggccgccctcccgcaggaatcttccttcactacgctgtcagccggcctgctccaagggccagaagcagaacagtctccgcagcggggttaaagccgggcgaaggagggcaagtgctggtggaccacctctcacgacacaccgttcctgtttatctcagtgtccgtcatccgcgggagcagctttagagagcgactgagcgtctcgctccggtgtacacagcccggcaaagatgccagcccccgtggagctgcacccaataagcccaccttctttcccgtcgccaccccggagacgcccatcgggctgagctgcgaataactaagagagaggccaagccaagtcgtggcgtttgtggcagccccggacacgggcaccagccagtcagcggagcctcctcacctccgttgccagcgaaggcgctcgttaggccttgggaagaggcgaccggaggcgatgcccgcgaatttgttaggggggtaagcggcgggtgaggtcctcgagggcggtcccgtttgctgattgagcggtagacggaggcgatgttcgctgacccaacaaggacagcaggtggagtaggcacagatggaaaactgctgccggtgccctaagcagaaggcaggtggaaaaatcagcactaggacgtcgaagcgatggtaccacagtcaaatcccacgacgtctacactctaccaagcacttgcgcacgctcccccttttccattcagtactcccaagaggggttcggaagaaccccgagtccattgtaagctcaggggagagcgggagccagggaggtgaagtgcgcagactcggcagcggcggcgggcagaaccgcgggggggtgagagggcgcggtggctgcggggcgggagccgctgctgagaggcggcctgggttgtcttgtggggtgactgtcggtggaatctttggtggagagtggtttggaagaatggcgaggggcggcagtggggagggtggtgaccctgagcgaccggccagggcgaggaggctgtgctgtccctgcaggccatgtgctcatttccacttacctggcaggggagagaccgtggtcacgaagggggttctcccagagtgaagcttcttcatctcactctagagttgctgatccctgtgatttcctccatgtgggaaacggtgtttgtgctagaagaggctgcgctctttacctgacataacggggttcaagactgacaacgcctcacgcccacccgaaaacgtttacatggcttccttgtctctttttttttctgtcctaaagtcgcctcatcttcacatcccctcttttttttcttccacactcgagagtgtctctctctctcagtaaaagctccaccaaatatttgaaatatctcaaccagaaagactgcaataaatacattatttcattcgtggaaggtacagaccagctagattgagagttgcttgatattttctgctaaacggtgaggcatagagcacttggaaggtttctctttgggccactgtttgtgtactcttgggtttccttcttttccccagacagtatggcgctgtggggccaggggtaaaccctgctttccggctttctggctgcagataaaggcctcagctggtgcaggaatcaaaagcaaaccaaaagacacgtgggttcgccccagtgggtccaagatagagtctgactgtaccaggattccgattagaacagaggttgctgcaggcacaacgcagactactaaccactagagaatcccaaggcgccccacacctactgcccgtcgttttgcttccccacccctctattatttatttgtatatttttttgagagacagaatttcgctttgtcgcccaggctggagggcagcggcacgatctcggctcactgctacctccgcctcttaggttcaagcgattctcctgcctcagcctcctaagtagctgagactacaaacgtgcaccaccacgcccagctaatttttgtatttgtggtagagacgagctttcaccatgttggcccggctggtctcgaactcctgacttcaagtgagtgatccacccacctcggcctcccaaagtgctgggattacaggcgtgagccaccgcccctggtcccccgattttttttattaatgtaaaaacattatgcgatttttacttctttattcttgggcagctacaggttcttgtgattttctctcacatcttctccccatttccccctctccattctgatacatgtcccatcttctctgcatccagccggtgccctctgcacgggcatcctgggctgtcccattgtctagtcctggtctcccctgcttctccctcctccttgtcacgttttcccttttgactcccctgcctctttcccgctcccgccccaccgaccccatctactgaagccgagttgagtgaagggagagcaagcggaacagatgattgcctgaaggcggcgcaaaagaacagaaagagctaccgtgagagccgtcggggagttcagcttcccttgggccctacttggctcaggctggggtcgcagatccaggcatttccagaggcactggcttctgaagcaggcgagggtgaacgcagggtgaaggccattcggccgcccttctggcttcagagtcacgcaatgcacgcgtttctaacgtgcagcaagacgattagtcgactcagcctctccggttttctgaagctttgtagtctgcacagttgtcccgcagaaagcgaatggcaactcctagggtttagtgattgcttaatctatatagagatgaaagcaagcgattgaggttgtctctgtggtgcaatcggttagcgcgttcggctgttaaccataaggttggtggttagagaccacccagggacgtgattttaaatgttggttgtgaccaggcgcagtgcctcacgtctattaatcccaacgctttgataggctgaagtaggggaagcctccacggagctcagaagttcaagaccagtgagaatcccacctcatttaaaaaaaaaaaaatgcagttgtatctatctcctcagacccttcaatgtatttaaaagtgaaagactgttcccttgtgtcttgtgcatcccatgaggacagacagcagaaggtccccctccaagcctcctagaaaatgagatctctgcagaacaaactagcttgtatgtacgggaaacggaaagtatttgaaggaacaaacttcaaaaattctgccttgctttccacaaaaattaacccatcacagtctgccttcaagtggcatcatacctcttcccatgactcctccccctgcctttatgctattgtcatgcattttactttacacctgttataaaccttacaatccatctctattacttttgtttcaagagtcagatgtgtttttgtttgtttgtttatttttgtttttttgttgctggtggtggtgtttttaagacgagtctcactctatcggacaggctggagtgcagtggcacagtcttggctcactgcaacctctgctttccgggttcaagcgattctcctgactcagactcctgagtagcagagactacaggcttgggccaccatatcggactaatttctgaatttttagtagagaggaaggttcaccatattggccaggatggtctcaaactcctgacctcaagtgatccaccttccttgaatcccaaagtgctgggattccaggcgtgagccatcgtgcccggctaaacagtcagatgttaaaattatatatttgcctatgtacatgtcatttctagtgtcttttttttttcatccagattttcatctggtgtcagtttccttctgcctggaggactcctttaacttgtctattaggtgtcttaaacttgcactgtcattcactgatgctctgttcatttaaaaaaaaacttgttggccgggtgcggtggctcacgcctgtaatgccagcactttgcgaggccgaggtggtagatcaggaggtcaggagatcgagaccatcctggctaacacggtgaaaccccgtctctactaaaaatacaaaaaaattagctggctgtggtggcgggcgcctgtagtcccagctactcaggaggctgaggcgggagaatggtgtgaacccaggaggcggagcttggaacctgtcaaaaggcattcttagccttaaaagaaaagccagggacatcccttgcctcaggactctcgaacttagaaaaacctttcaccctctatgtggatgaataacaagggacagcttcaaatgttctaattcaaaggctgaggaattgctttggaccagtggcttatttctctaaacagctagaccaggtggcagctaggtgactaggaagcttgagatctgtggctaccatcactttattgttagaagaaaccagtaagtttaccttgggacaaaaattacatgccataccaccccacccccaccccctgccaccccatgaagtacagtacagagggtcctagaggcaaaagtacaccaatggctaacagggagccagttacttaaatatcagacccttctgcttgacaccccagatgttaccctgaaagtatcctgattttgaaaccctgctactctgttgctgcacctcacatctcaagaaacagatcccaaactcattgactcctgtgtggaaaccacggaagagctctactctagaaggcccaaccttgaagacaagctgttgtctaacccaaatgttgagtggtttagagatggaaatagctatattcatgagggagtaagaaaggaagcttagccaacaagaagtcattgaggccaagggtttaccttctcagacttctgttcaaaaagcagaattagctgctctaattagggccttccaaccatgaaaagacttaagctggacacggtggctcacgcctgtaatcccagcactttgggaggccaaggtgggtggatcacctgaggttgggagttcgagaccggcctagccaacatggcgaaaccccgtctctactaaaaatacaaaaattagccgggtgtggtggggtgcgcctgtaatcccagctacttgggaggctggggcatgagaatccctgagtttgcagtgagctgagattgcagtgagctgagatcatgccactgcactccagcctgggcgacacagcaagactccgtttcaaaaaaagaagaagaaaaccaaaacctcaagagtcaatgtgttgactgactctaaatatgggttcctggtgctccatgctcatgcagccatagggaaggaaaggggactatcaagagccaagggatcccccacacaactttactcagatcttggaacttttagatgctgtccaactcccaaagaaataacaattactcactgcaggggacaccagaagggagacacttttattattagaggaaattccctggtggaaagagcagctaaggccacagctaaggaaaccctggtatttcaggctgctgcgctactaccaggtactgcatccgtgtcagtgacaccatactatacccctaaggaaattaaagggactgagtaaaaggcttccagggagacccctctggatggttgctagaaaagaacaaactctattcctgaggctgacaaatgggaaataattaaacattttcatgattcctcacatttgggacaggattttccatttaaattagtttcctaaatattcttgcggaagggactgttccaaactataaaaagggttaccactcaggaagccaccccataccccgatccctgcttaaacctgtacaacaccaaggaacataccatggtgaagactggcagacagacttaacccagatgccaccttacaggggagtacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctatcttcactcctcatggagatctcagtcttcaaataacatagaaagccaatcgcgacattagcaaaactctttcagtttgggggcttgcctgccctgcgtcactatcattgtttccttgggtttcccaggaatgtacatgtgtcagactgccgccctgcttatagatctgtttccctgcaaggaaacaggaatatgttgcctgtggcttccagagttggagatacatgtagttgcacccctgagggctaacatttaattttggaatcaagtgatgcattcagactggttgttatcattctgtggtatatatttagtgaacacattctgattgagtttcctgcttttagctggagcaagaaagtttaataattgtgatttgtatgaaaaaaatcataggcaagggaatgggtgtaaaataaactttattgtcagaggtttctaaaggctcatccttcaaggaaaacggacatatgctgaagagctgataaaccgtctacagcagtgttattctaagctaatcttgattccaagttcttgccattttcctccagctgctgttgactccagttatatataggatgggggaaaggggattatctatgaatgtaggcatcactctctcttgggcagttatcacattggcagactgaagggatgtgatttctacagtcaaactatccatttggagtacaaatctggagtggctgtaaaattcggttctcagagatgaacttgcagattcagactttcaattgttctgttgttttagtttttctcatcaactggggaactgtttgtgactaagctttgttaaaagtagagaagagtttttcatagttccaacattagttgttacccgaaacaaacaaaaacacacacacatacaattaaacaataatctttggtgaggtcttgctgatacctgaggctggagtgagagctgactggtgatacaggccaggtgcaaactgagtgcaactaagtggataatctccagtagtgaactacagtctagaagaagatagtaataatagattaaaaaaaagtctcctgaagtgaaccagctggcgtgtggtgtaggacacaggaccccacccaccttatgattctaagagccttgctcaaagccactgcagttgagttcgctaggtctctaccacctcctcagcatcaattgactctccataatactcctctggagagaaataagggtctttcaacctcccaggaagggatttgcttagcctcaaatatgcacattcaggaatagcttgtcgtaagaaagagaggatagtttgcagagaaataaccctcctaagtccacatcctattccttttaaataagagagtggtgacaagggaagagccctagaatgtcaaagccaacagggtgctcagataccacccaagtacagttccatctttggccataaggagacaatggtgtcaagaggttaaggccgtatgatctgtaggtgaaaaatctgggatgggaatcaagtcctcaaaccttttccactacatcacagagtttaggagcagttagagggaaggcttcaatctggagaacactaacaggctctagagattattgggtcatggtggctgggacagaaataaggattcacagaaagatgtttatagtaaatgttcttttgggattttgcttgataaaaaggctgagcaaaagtaaaaatttatttcttttcttttcttttttttttttttttttgtttagacagtttcactcttgtttcccaggctggagtgcaatggtgcaacctcagctcaccacaacctccaccccctggggttcaagcaattctcctgcctcagcctcccaagtaggtgtgattacaggcatgcaccaccacgcccagctaattttttttttttttttttttttttttagtagagacagggttcctccatgttggtcaggctggtctcaaactcccaacctcaagtgatcctcccaaagtgctgggattacaggctccagccaccacacccggccaaaagtaaaaattttctaattgcaattctgaaccacttaggggttgtgaaatcaatatagtggactgcttattactacaggctttatttaaattctaggtagggtggattacacatagtaaaagattttttaaaaactgatcacaggacaggcgcggtggctcatgcctgtaatcccagcactttgggaggctgaggcaggtggatcacgcggtcaggagattgagaccatcctggctaacacggtgaaaccccgtctctactaaaaataaaaaaaaaaaaaattagctgggcatggtggtgggtgcctgtagtcccagctactcaggacgctaaggcaggagaatggtgtaaacccgggagggcggagcttgcagtaagccaaggtcacgccaatgcactccaacctgggcaacagagcaagactccatctcaaaaaaagaaaaaaaaaaactgatcacaaagaattgtatatttctcactgcgtcttgtggtcagaaaagtttgagaaactactctacataggcaaattacaggtccaatctctccatctacctctttatctcttctctatttccacgctatgcagacaagaccacggagagaggaaggcaaattccatcaatgggtgctgttaagccttttctatgaggtagctgcacatttggggcacttcaatactggttacttgagattctagtagacagattgtccttttcatctctagccacatggtaaaattacttgggagctttttaagactactagtggcttccacccacctggaagcatttaaatcagaatctctatgtgtagagtccaggcacttgtgttagttaaaacctcaccaggctttataatatgacagagtggtttaaagctacggagtagacccaccctatttcctacctttctctttgtttctctttcaccataggcttctttcccatgagaaagtaaagattttagtctctgttttcagagtctcaagtaaatcactctctttctcaactggacttccaaggcaaagatttctttctatttatctatctgcatttttacaaagttggcctctggattcccttttcccaaacctaattcaccacaaaggtgcccctcaagtcaaggagctgggctttcatacacctgcacctgtcaatcatggtaaatattttgcaggcagggttgctgggtgctgtgggattgacgtaaactcccaggtattgccagctctgagcctcaggcaagcttgtgactaaatgactccagtagtctgaggatagtccttactcagaagggtctttggaagcaaaagcaaacataggcatgagagggtaaaaaaaaaaaaaaaaaaaaaaaaaaaaatctcatgtcatcttggcttatacctaacagaacttgtgcaagaatggatattaaggtgggtattgtacagagcagaacttaataaataccaagtctggagtttaagggataggctgaagagattttgcaggcttgtaaacatttttgccaacttgaacacacttttgtttgggtttggtttttctcctcattggtaagagctacgcacaatagggtagctaagatattataatttgaatcgatacatttgtattttgccaaggatcaagatgaactatgatgatttccattttttagtactttattttcatcagtttgaaaattaggacttttgctccttttttggcttgtggcacctttttggttttcacactttctcaaagaccagtaacttagaatctaaattatgattgcttattctttcagtactctaggggaaagttgatttaatcttgacaaaatgtattcagttaaaataattgttctcttaaatctttctttctttctttctttcttttttctttttttggagatggagtcttgctctgtcacccaggctagtgtgcagtggcacaatcttggctcactgcaacctccgcctcctgggttcaaatgactctcctgcctcggcctcccgagtagctgggcctataggcgcatgccatcacgcccggctaatttttgtatttttagtagagatggggtttcaccatgttgttctcttaaatcttttcaccttttaagtttgtccttcctttctccaatttgcaataggggagtgtggctcgcagctaaatagtagacttctcagagctacttattcctggagcctggcagtctgcaggcctggagggggagcatctagaaagcagccctctctaagttgagaataactatgagaattgtgggttataaggctttgagcagctctggcctccccgtcctcttttgtttctactgtgggatgtgacaagagaaggaactcatctgagagagacttcatattgtggcctttcaccgattacttctggaaatttgattcaggcaagccagggagagtgtctggtattcttctctgagaagaagaattcattatacagctggacaatggaatctatgatctgcctgtagaggttagaggtgcatcctgttccgggaaataattacaatttaggcaagttatacatgtttgcttaagagaatgctttctgcacatttcatgttcttcctttctatcttagcctagggagaaaaccgtggggactcagggctggaactttagtgtgatggggcagaagcttaattttcacatgattctcaacaaatggcagcatatcccatgtattatcatgtccaatggctgcaatatgaaggaggcttttccgaaatagttgctgctttggtaaaaaattaactagatggattcaaagtcaaatttgaagaaagctgagcaggcagaagaaacaatcagtgaacctgaagataaggcaatggaaatcatccagtttgaggaacagaaataaaaaaagattgaagaaaagtgaacagagcctaagtgaccatcaagtggaccaccatgtacattgtggaagttcttttttgttgttgttgttttggggggtgggaggggggaaggagtttcatttttgctgcccagactggaatgcaatggcgctatctcagctcaccgcaacctctgcctcctggtttcaagcaattctcccacctcagcctcccaagaggctgagattgcaggcatgcaccaccatgcctggctaattttgtatttttagtagagacggcatttctccatgttggtcacgctggtctcaaactcctgacctcaggtgatcctcccgcctcggcctcccaaaatgctgggattacaggcatgagctactgctcccagccttgcattgtggaatttctaaagaagagggagagaagggcaatagagaatatttgaagaaatcatggctgaaaacttcccaaatttgatgaaagacatgaatacaaacacagtagcctaacaaactccaagtaagataaacctaaagagacctacaccaaaacgcattataatcaaactttcaaaagtcaaagagaatctttaaattggtaagagaaaagcaactggtcacatgcaagaaatctttaataagattatcaacagatttctcatcagaaactttggaagctggaaggacaggaaatcaaaagctgccaacaaccaggaggggtggctcatatctataatcccaacactttgggtggctgaggcaggcagatcacttgaggtcaggagctcaagaccagcctggccaacatgacaaaaccctgtctctattaaaaatacaaaaattagccaggcgtggtggtgggtgactgtaatcccagcgacttgagagaccaaggtgggagaatcacttgaacctgggaggcggaggttgcagtaagccaagatctcgccactgcactccagcctgggtgatagggtgagactctgtattaataaacaaacaaacaaacaaaagctgcccgtgaaagggaaaaggatcaataaatgggtattccaaaaagtcaaaagtcacacaaatatcaagccaaaataaactggtttcctgactggaaatcgaccccaggctatggcagcaaaacacagaactttaagcactgaactgcaaggtagagcagactttattgtgcatcctggaagggatccagagcaggcagtttgagcttatgaagaattttaactttgtttcgggtcaaattttgctctttaatttagttaagagaattttttttccctacacaacacacataatattgtcaagagaatttttaagggtagccatgacactattatgtgtgtttgttttaatttgatcttcctatgaactgttaaaataagagatctctaaaatcttttttttttttaattcaggtgtctaatttaagggatccatcttcaggccattggcaagtagaatttccaatggtgtaattattgcaatagcaattcaaccaaatagcccctttgtggaaagcccaggatgtcattttccaggttaacctcctgggaagggcaaagaagaagcaatcccaaagattcccctgcaagaaaaaagttcaatgcaaggagtagaccacagatgggtaaggatgatgttggcctccagtaacccagatatttatgggggcttccagtcacagacctctgaatctataataccaggtaggccctcttgggattgagctttcctaggactaaccaggcaacaagaattgagatgacaaaagcctcaaagggatgggacttcttaagacaaaccccaagagcttgacatggtcagaacaaaaagtgtgctggggttcccagccattttcagacaggccacctagtatgacctgatagttactgcctctttccagatagtggaaaccaagagaaagcgctcccacttgctcacaagtcaagctctcaaggacataaaataagatgagaaggaacctcaaccggtacccccttttatgacagaataacacatagagacaaagacaaaggaacagacaatttctgggaacaaagggattaaacaataggaattggtaccacaaagtaccaaaaagcacaccagagtcactacacccaagactagtcacacaaatccttttctccaattaatcaagattttggagagggaaaagaaagaaacagtgatttttactgtccacttgatgagattccacacagagaaggaggccaggagcctggctggtaaaaaaattcttacccttatgacagctgatcagatcctgggttcttcactgcagcttccagaagagcagagctttcctatcctgcttacagctccaaaactgtaggggccaatggaaaccctccctcttaaccctctgaagtttcactcaaaaatcaagtcgcaaaaggcagattaattggaaaaaaggcataaaatgtactaacatgtgcatggggagagtcacagagtgattaccctcccctacccacaatgggatgcagaagcttatataccatcttgaggtaacagaatgaatgagggctcaaagcatggccaaaaccaggtgcaatcagagtcagaggtatatccaattattgtggacaagataagtgatggtagggagagaagaggaggcttggctagcaaaggtggtcttaatatgtaaatgaaaccctacagttagcagctctcagagagaataaaccctaaaaatttctttcagacctttacatgtgtcagactctcagttaatctttcctagatctgggcaaggaaagacttggctgtatcaatgcagattccctacagatgcaaatctccccaacaaaagacaactttgcagggctacttctgcagctggctttctgaacagacatctcaaaatatgtcaaagaaatgtagtttggggtcaaatatttttaattccttcacatctacagcctgatgcatcggccgtttcaatgcaacattgttggtggcaactccattcttccctatactcaagccaaaaaaccaggttctccttgaggctagtctttttctcacagcacacatccaatttgtcagaaaacttatgtttcctgtttggttaattacagattttgatctgcccaatctttctctttcttggtctctgaattttggcaaaggagtctcctgatacaggcaggatagattctactgacgattctcaaaaccgtcagacacttaagagccttaatctcggggtaggggtttgggccgccctcgaaccttttctttgggcctccccatcaaaatcagtctggccaggcctgtcttcaaggcccaggggcagggccaggtcctcccgatgcttcttgaagcttctcctgccgggtcagcagccaccctccccttccctctgacctgcagagaagcttcagggggcatttattcaatttgctaggagctcacggatgcaggtgcgcggtgactctgtggttcccaccgcacccaccgccctccttggtcctctcactgtctgaagcgggcagtaatgttcagggtgagcttgggctccgaagacacccagtcaaggagggaccagtagggaagggcactggccccttaggtccttcccagctagggatccgaaaaagttcttgaagaaatagaaagggagagttggaagtagatcaaagggaaagaaagaaaatcctagatttcctatctgaaggcaccatgaagagaaagtccgcctcctctgggccgcgtcctcacgtcgctggtgaaccaagttctgttctccattggagaccaaatcagttgactttggcttgactcctagtgaaggagccccgctttgtcctcccctgtttagctcttgatcctgaagcacttgattgtctctcccgggcttttgatggatttcagggatgcaactgagaaatttgtttttaatgcacttaattgaagtaagaatattttaaagtattttggcaaagaaaaacgtttccttttgcaatgaagacattcagatgtaaggaaaatcactaggctctcacaaacacaaattccatgtcagcaagtagatttgaccctcaggttgggcacactttaagtgtactgttggaacttaagatgaatctaggacattcatgattaatatttttagttttttagtacaatttaatattttaaatttaaatacacattctgaaaattgtataaccagcacaagaaaccggctttacgccatatttacaaacataggaaagaaagatgatattttaaatgacaatgcttcataaatggcaacatttttaaagtacctagagaaaaaaagttaatctagaattctatgcaaaaataaaatttcataactgtgagtgaaataaggacattgaaaaaatacaaaagctaaaagaattcaccaacccatgctgcaagaaatcttaagagtcctccaggcagaagcaaaaggataccagataaaaatgcgggcctacacaaagaaacgaatattggaaatggcatttagaaaacatgtactacacgttttcttataatttaaatctttcaaaaaatatttgacgtaataaataaaagtaataatgaatcacaaagcttatagtgcataaagtaaaactacataacactaggataaaggccagaaagggaggcataatgacactagaaagcagactatgataaattaaagatgtatcccggaaaccctaaagcagcctcttaaataagaaaagggttatagctaataaagcaacaaaggaaagaaaacggaatgaaataaaagctatgtaaacactatgctggaacaactactctccaggcctccaccctatagaaatacaccagtggccaatgagagtgtacaagaatgatgactgcagcattacttgtaatcataaaatgataaaaccaacgtaagtttaaagatatatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgctacaataaacaaacaaaaacaattctcacttccagaagatcccgcctgtgcctctgcatgcgcctttcaggaggtctggatgtctggtccaccgctcccgggcttctttcccagcttttgcttttccctttacctgctctcgccctacggccccagggccggaccacggcccagctgagccccgcggctccaccgcgcagaaggtgcgccggaggccctgccagtttcccgccctgcagggtactgagaaatcaacgatttgtaaaaagaacttccccatggaaaaaaatctgttgatttccgctctcagggctcttcaaaggactaaaagctaaaggcgacaatgaattcattcgacaagtcctagtcgtgagccctggtgagtgccagaccctgctccccccgaggggacccacgagcgaccctcaccaccatccctgccctggtggagcccccgtgcggaacacaggatccgaagatggcagcggaagctcctccgcggccccgagagcgactgggcagggtgggcacaggctcttcaatgggtgaaggcggcgcaaagaacgggaagaaccatcccaggagcccacagggcgttcagcttcccttggggccccaggcggctcgggctgggtcgccgacccgggagttcctggaagcttctgaagcaggcgaggggcagggcgggcgaaggcaattccgctgttctggctccagaatctcctaacgcgcaggcgtccaacgtgaccggcgcgactcaccgctctaatctctctggttttccaaggccttgctcggtggtcctgccgggcgggctctgggagtagagggaagggagttagttcagtgagtgggcccttcccatatcaccagtagaagcggaagcgcttgtctctgtggcgcaatcggttagcgcgttcggctgttaaccgaaagattggtggttcgagcccacccagggacgcttattggaacttttgaagcattcatgcattgtcaatcactaggtaaatggggaagattttatcttcccgaagtcccaagccactcatttatgactgatccatgtcaagggccgcccacctccccgaccagattcttaaccggctatctcctgaaatgccgggtttacacctgtgtaacttaggaatcctgaaacagagacctaggaacccacttctggtgtgataaaattctaattcagtcccttatacgcttaaacaagtaattcacgtgcctccattttttcatattttagtaataggagtccagtattacctccaggatgtgcctgggtttcctgattgctctatcaataatgtgaccagtggaatctttcatcatgatagtgatcctctccatcatttttgaaaacagtatttttcctcagtctgtgcatgatttatttaacccttttcaaaatgtttttgttagccaggcatggtggcacacacctgtaatcccagctactcaggaggctgaggcaggagaatcgtttgaacttgggaggtggaggctgcagtgagctgagattgcaccactacactccagcctgggtatcagagtgagactcccatctcaaaaaaaaaaaaatgtttttgagatgatgttggtttcatggttttaggattacaaagaatgctgcagtcaccattcttgtacagatatctttggtcattgtggaaatgtctacactgcagacatttctatagtgtagagagctggatgcgccattgctacattatagtgcttatataatgcttctaatttgagtccattctgcaaatgtgtctttcacgggagcagtaccaaataatattccaatatgaatatttataaaatgaaaatgtgcagatgtgcagttgagctgcatgcctctccatggggcccatgttcataaaatggtggcgttagcaatcatctgagagtggagtttgtggccctctgacgtcaaaatctgaggcaatggacatgaaaaccctcactgtacatcctccgtagtctggccagaatcattcctgggtcggtggtctcttatcaggagggaatgctgcttgctttttttgtcaaaaccacaaaagggagggaaagcatcaggctgttggttgataacagtagtgaagcaagtctctccaaaggcttggtttgttaacccttaggaaaaaaatcctaattcttgccagatggtgccatgcatttccaggctcttggtgtcccaaacaaagaactgtacatgacacacacaaagcagcaaagcaaagcaaaagtttattaagcatagtaacactctcagagtggggagagtggactgacctctgggatgtaagataagtattagtttggtgtactttgggtcgttttatgtgtgtttttttttcttctcttcacaaggatgcctaatcgttagccagtgtttgccttttgattgataggtgggttgcttagttactttggcccttgtgtgcttgcacattggctccatcccataattttaagtacatgcatgatgtgcagtccatatgcatgagttttaatgagctgattatcatacggagtcatgttaaggatactttttttctctcatgcacatgcctatctctgaggagctgcccctttactggtttggatctcgctggccatggggtccttgcttgcttttcttttttttttttttttttttttttgagacagagtctcgctctgttgcacagtctggagtgcagtgatgcaatctcggctcactgcaacctccgcctcccgggttcaagcgatgcacctgtctcagcctcccaagtagctgggagtacaggagtgcaccaccacgcccagctaattttttgtatttttagtagagatggggtttcaccatgttggccaggctggtctgaaactcctgacctcaggtgatctgcctgccttggcctcccaaagtgctgggattacaggcatgagccaccgtgcccggccttgcttgcttttttaaatcttactttttgttttggctgctcaacttctgccttttatcttgcttcttgctctcccaccccatcaccttgcttctgtttctgcttttactcgttctgccttttatccaacttccaattccctctgctgttctcctgcctcataatggcagttagtgagcgggggttttgaggtggcatgtccaacctcctagcctgccacatccagaaactgctttcaaggtttctctgtggtcctgtcagccaagagggagtccgcagttgactgtagggactagggcttattttcatttctcaatcctgacaaggtaaggctggattaacgcagattctctgcaggtgtaaatttcccctacagaagacagttttgcagagttccttctgtttgctggttctctgacagccatcttaaaatatgccaaagaaatacattctggggtaaaatattttgattctcttcatctatctacagcttcaccatgctggcagcctccaatccaagcatacctgaaaccttcttttttttttttttttttttttggtttgagacagagtctcgctctgtcacccaggctggagtgcagtggcattatctcggctcactgcaagcttcgcctcccaggttcacgccattctcctgcctcagcctctggagtagctggtactacaggtgcctgccaccgcaccagactaattgtttgtatattttttagtagagatggggtttcaccatgttagttagggtggtcttgatctcctgacctcgtgaccacccacctgggcctcccaaagtgagccaccacgcccggcccctgaaacctttctttttaaaaagctttcccacctttatgactgccttcaagtctctgccaaaacacaagtaacagtgactgactccctgctataccaagctcacagtaaatagcctttgctgtttttcatttggttggtctttgtttatttgcagaagcttcaatgtagagttgacaaggactccaatctttgaccaaaccttagtagtttcctctgagcccttttctctgttacttcttggcctgccaagtccagctttaggaaagaatcctgttgagtctagtttagcaagagtcctcgcaaccacctttgatagctaatcaagttcctcttagtaattttccatccactgactttcttatcttgccaattggctataatcctcaactcctcctgctgtatttgaggttgagcccagttctctgggctcaacctcaaatacacgtgtccagtgcagcccctcagaaactacctttgcaaaattatgacaatcagagaaagctgacatggctgactccatcttggttctagcctcacaggcttgctgtctttgctcattcctgtgcaatttctcccaagctatctttgggaaaaattgagtttatagtttaaatcagggctccccaatccccagggccataagacaggtactggtccatggcctgttaggaacccagctgaacagcaggaggtgagctgcaggctttcgagcattaccgcctgagctctgcctcttgtcagatcagcatgagcattagctgctcatcggagctcggaccctattgggaactgctcatgtgagtgatccagattgcgcactccttatgagactgtaactgatgccactgatgcctgatgacctgaggtggaacagtttcatctggaaaccatccaccacccccttccatggaaaaattgtcttccatgaaaccagtccctggtgacaaaaaggttggggacagccaaaaatctggtttaaatgataaccttccccaaaactaaattacccctgtaaaatgaatgaaaggccaccaagttagaaggatgaaagcggcctgatttctagtaagatgtatgcctccttaaataattaccagccattattccagaagtcacaagattggcagcttccccagttactgctgtgaagaacatcactattgtagaacctaagattggcctcttgagatgtcttttcaggctttggcatttctgactgctggatggcaccatttggcccgaaaatcaaccagtcccttagcccccacccagaagctgactccatgcaggagggccattttccatgcccctgtgatttcatccccaacgatcagcaccacgcaagccctagccccctccccaccaaactatctttgaaaaaccccttacctccaagccttcagtgagattgctttgagtaataactcttgtctcccacatgtcgtggctggcctgtgtcagtgaaactctttcctgcagtgccatggtctccatgaattgattttgtgtgtacattgggcaggaagaacccatcaggtagttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatatcttgccatgccttccagtggcctaactggccaccatgccacagaatctttatggtctccaaggagaactctctacttgatgttttgtgatttgagcaatggaatagaatctgatactggtgggctgggggaggtacccggacactggtgggatctcgaccccagccgtggtgtccaggctcttgacaccatcgcgagaacaaagtcaaagatgagtcagcagatagtgaaagaagagatttattgcaaagcaaaaagtacacactcaagaaaggggagttcaggcatacccaagagagaacaatggattctggggtttcatcttgatgggtttctttaaccaaggagtggaatgttcatgaaaattcctgggtaaaggtggagatttctcggaactgtggtgccatccatttttacatcaaatattggtctcagaactgtcatggcactggcgggtgtgtgatttagtatgttaatgagcatataatgagggcctaggtaaaacctccgtcaaatccagcaccacattgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacattgttaaacatctcaaataagatgtagcccaggtatttgtgtcaaatttggattattttgatttcgtctttgcagaatataaaaaactaacatgaggtaagcactaaggtgtggagatggctgtgcaagagatgacaaagtccagcaccacgcttgagagtgtccaatcatctcttctggggcagcatagttttctacaatactgattttggaaaaaaaatcaaaaaaaaaaaacctacaagattcatgaaactggacaactgtctttataacattaccagtgataaaaccagtaaggaaggctggtttgcagtcatctgagcagcctctttactttcataaacatggtttctctcggcttccaattgcaagtggaatgctgcatcacagggataaagatgtgaagagaaccggtttcttctgtaatccgaaacattctagtctgcgaattaaaagccattatttgaagaaggatgccccggctccatctggccaccgaaaggttgctccttaacacaggctaaggaccagcttttttgggagagaacagacgcaggggcgggagggaaaaagggagaggcagacgtcacttcctcttggcggctctggcagcagattggtcagttgagtggcagaaaagcagacggggactgggcaaggcactgtcggtgacatcacggacagggcgacttctatgtagatgaggcagcgcagaggctgctgcttcgccacttgctgcttcgccacgaaggagttcccctgccctgggagcgggttcaggaccgcggatcggaagagagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttctaaaagtagactgtacgctaagggtcatatctttttttgttttggtttgtgtcttggttggcgtcttaaatgttaatcctacagtggagggctggcgaataggaagtaacatgtcgcctgcacgccataggagaaaaagcgagcatcagccgtatcggctttgtaacacaaattagctatcgtgaagtccgctcagctcttccctttctaccctggctgctttttgcagggattggtccgtggtctccagtctcttgggttctcaccctgtgtgaaaatcttcctgtttttccctaccccccaagtcacctcttacacagcctctgcttccaagcgcagcccccacaggagtttgtaggatttctgtgctagcggggagtgtgttctcacctcatagagccaggtagaaactacgcagatgggtgctgttctccaggaagaaagcagggcctttggggctctcagtgtccccgttgggttgtagacataacacgcttactttgcgtaggggaacggctctgccggcccccaggtgccctcgcgcatattcatggaggcccgtaggtcagaaccgcagtctcacctgtcttggcggaaatgccctgcgatcctcccggagatagaaggcgggaagttttatgaggagccaggtacagtttccctactatctccggcagttcatatatctagtgtttcttcagactttatttaagcgacagcttcttgtttgatgtctcgctcccacatcctacatccattgccaggcaactttctagatagcacccagacccatccttcccacccccaagcagccgtttcctatttctggtgccagtgtcctccccagtccctctttcttcaggccctcgcttatcaccttcatggacagaaaatacttagctctctctcaacctgcggtttatacctgacacgcgtcagtaccctgacaaattccttaataccctttctcaaatggcactgaaaatgcatttctttttaactcccagaagtatctaattggttttgtccctgaactacatgaatactagtattccactacagaggaaaaccccaggcctagcgatggcggttctgggcattgtgccagcctctcccagggtatgttttctgacatcacctacttttgatcaactgaggtcaggagttcgagaccaccctgaccaacatggcgaaactccgtctctactaaaaataaaaataaaaataaattgccgggcatggtggtgtgggtctgtaatcccaactactcgggaggctgaggcaggagaatcgcttgaacccggcaggcggaggttacagtgagccgagatcgtgccattgcaccccagcctgggcaatagagtgagactctgtctcaaaaaaaaaaaaaaaaaaattagtccatctgagacattgttgttggagacagtagaatcctgcatccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctttctcattatttgcatcattattttttgccatcagtgtgggtttttggttttgaggctatgaagtgaatttctggggacaatctctgttgggtcgtgttgacaaggatccagtccctgtttggtgatacatgacagctaatctggtctgtgagtcttctttattgtctatttattgtcctgagaataatggtatttcctgaaatttgagactgcagcaatgataagttgttcagatcttgtctttccaatgtttggtaaaaattttataggcccaattgttgtcaatatctgcaagagtggcatctctattacaagagtgatcttactactcaatgtcccccctcccacccaacttcatttcctaggggctcttggctttaacgaatttactgtatctaaaagacatcttagtacaggaagaaaactaaatctgtagcatgtaaggagcagttttctttgattggtatattcaggtttctaaccagctgaaaaattcaaatacatgtcctttaaggattaagtttaaactacactacagaaagaagagaaaagatttatatgatcacatataagcaatggaatcagcaatatgagcacttttcacaactatataaatcaaatttagtaatctccagaacattaaggaagttcagcccttaatgaaaatgaatgaaaagaaattattcacccactgttacatgccctggaaagagaatgccctgcaggactcaaaagggtaccacaatattactcagattttcagcaatgaaggccctccaaggatctaatgatactcatattttcagtttatttccttcactgataaacattgttaatagataccattgcctctgttttcactttaagtgatgttacttagcacaattcatttctttagaatgccccctagtttagtgaaaggaattttcctgctttataaatataggatattttctcatgaaacaagttggcgtactctttcagtgaagggactagaccgattaggtctctaaaatgttaaaggagtcactgcctccattatcttaggaacaataataatcacttatataaaattaaaataagaaaattaagccaggaatggtggctcatatctacaatcccagcacttaaagagttggagaccagcctgggcaacatagtgaaactcctgtctctacaaatttttaagtattagctaattttttaaagttggcagggcatgataatgcatgactgtaatctcagctactagggagactgaggcaggctccagtgaactatgattgtgccactgccctccagcctgggtgacagagtgagactcccaactcaaaaaaaaaaaaagaaaagaaaatatagaatttgttgaaaattgttttactacaatgctaggctgcatgtcttgcacctgtactcccagcaactcaacaggctgaggcggaaggattgctttaggccagcggttggagaccagcctggggaacagggcaagacctcatctctaaaaaaacacaaggcaagctgagccaggaggattgcctgagcccagaagttccaagttggtcagctatgattgccctgctgcactctagcctggataacacagcaagaccctgtgtcttattttttattttatttttactacttatgcttatttatttatttatttttgagacagagtcttgctctgtagcccaggctagagtgcagtggtgccatctcagctcactgcaagctctgccttccaggttgaagctatttccctgcctcagcctccagagtagctgggattacaggcacacgccaccacatccagctaatttttatgtttttagtagagacagggtttcatcatgtttcccaggctagtctcaaactcctgacctcaagtgatgcacctgtctcggactccgaaagtgctgggattacaggtgtgagccacctcgcccaggctccttatgcttgaaatgtgaggtttcattagggaaaaattttcttgttgaatttctaacatgaaaaaataatagatttagctgtagattaaattaatggtcttgatagtttggtacaataaaataaatgaaatgaagttgatagcagagaggaatttttgatgcttttggacaatttaaataatgtaatatttaatatataaagacatgaaaaagttcattacattattatatttatttatttatttatttatttatttattttgagacatagtctcactctgttgcctaagctagagtgcagtggtacaatctcggctcactgcaacctctgcctcccgggttcaagcaattctcctgcctcagcctcgtgagtagctggaattacagacgtgcgccaccccacccagctaatttttgtatttttagtagacacagggtttcaccatgttggtcaggctggtctcgaactcctgacctcatgattcacctgctacggcttcccaaagtgctggggttacaggcgtgagccgctgcatctggtctattatgttattttttaaaagtcagtgtgactcttttgacaaattagaatggtttaataatcttggttaggctgggcatggtggctcacacctgtaatcccagcactttgggagcctgaggtcaggagttcgagaccagcctggcaaacaaggtgaaaccctgtctctactaaaaatacaaaaattagccgggtatggtggggggctcctgtaatcccagctactcagaaggctgagtcaggagaattgcttgaacccgggaggcagaggtttcactgagccaagatcgcgacattgcactccagcctgggggggcaacaaagtgagattcggtctcaaaaaataaataaataaataaaaataaagtataaaaaattaaaattatgtgttcaagtaaattaaatatatggcaatgaaaaggaggcccagcatgactgactgcattttgctcctaacccttcctaccctgtggtgatgtctttcaggctaactgctttttcttctttctgcacataggccaagctatctatgggagggatttagcttacagtttaactttaaagcacagatgataataatcctttccccaaactaactcctgagaagataggcaggttgttgaagatttataagagcagtgtgacctgacaaaggacaaagaattttcaccatccccttgggctctcactgcagcccatatgtctgtcattgtcagacctcttcacctcaaccgcctccttcttcctcccttccctaacgtacaaggaacctgaaaatcatattaatttaagatggttctttaggatgttagttcaccatctgttcagtttggtggctctctggaataaagtcaccttccctgcccctacaccttatccctggacttattggccgtcatgcagcaagcggtgagtgcagtaagccgagatcacaccactgcactccagtctgggtgacatagtgagaccttgtctcaaaaaaataaaaataaaaacagagaaatttggttttagaaccagacaaattaaatgggagattacttccagtgagacctagaaatttctaaatttctaaaatttctaaaaaaactgagaaaattgcctccattgaggaagtaagctgaaggaggtaaactgtcatgttttctgaattgagaaatattgaggaggctttgtctctttcacctccagctgctccttctcctcctgcccctgcacctgcatagtctttcttacctgagccttcctgtcctgccttgcttcttcttccatcaccaccacctggggaaagtccccagggctctggccacttccccaaaacttctgttctgacagcccctttaaaggtaaaacccaaacccacaggaagaggggagcctaccattgtgtataccacttcaccaaaacgtgaattaagaatattataaaggacttccctgatctaaacttaaatacatttcactcttctgtttctaaagcaggctccgagattctataggctctggcagaaaatttgacttaactgttgaaacctttgagcccaaatattctgacctttatcaatcaattcacatgctggtgaagaaggcaaggccactaactggttgcaaaggcaaattggaaggattttcaaaaagggactgaagcagaacatgaaaggttcacattttcaccaaatatctccatgttgccactccccaggtccttcctaaaaatatagattggaggataattcagcattgtactaaaaagccagacaaatctgtctttgcttaattaaaatggtttgagagccaggtgtggtagctcatgtctttaatcccagcactataggaggccaaggcgggcggatcactcgaggtcaggagttcgagaccagcctgccaacatggtgaaaccctgtctctactaaaaatacaaaaatcagccaggtggctactcaggaggctgaaggaaaagaatcgcttgaacccaggaggcagaggttgcagtgagctaagatcctgccagtgcaatacagcctgggtgacagagaaagactgtctcaaaaataaaaattaaaaaaaaaaagaaaaaatcagcagcgtagtagaagtataatgcacacaagaatgataatcatgaagacaatctgattctagaagagtaagggaacctattccattagagagccaactgaaaacatcaaatcccagttcacaccccagggtgtgggggcacgtgcctgtagtcccagctactcgggaggattagtaaggaggtttgcttgaatatgtgaggtcaaagcagaagtaaaccctgatcatgccactgcactccagcctgggtgacagtgagaccttgtctcaaaaacaaacaaacaaaaaacccacaaaaccaaacaacaacaaattgtcacctcactctgaaatgacagtggcaaacatcactttgctattggaaaattaaaagaaaaacactccctcttgctatcaacctgccctcttgctctaacatgtctgacccatggtttaaaatgcccaaaagctgatgtactcaaattataatacacttacctgttctgcaccagcatttatttttgtctggaggagatcaccatccatggtcctgtaaatgtctaacggcatggaatgatgaagggcagtgtcttttaggatatttggttatatctatatatatggctctgaagaaacccaacattgggcgagttccctcaaacttttcactaggcatgaccactgctctattttagatagagattctgtggggcaaaacctgagaattatctgcctggctatcaagaagatagctccttgcatttttttggggagaacacttgcttcaagggagtgtttcctcccaggattacaaatctttttgtaacctcaggaaacattgctgatgaaaaccaggcatggtggctctggcctgtaatcccagtgactcaggggctgagacaggagaatcacttaagccaaagagtttgaggctgcagtgagctatgatggcgccactgcactccagcctgagccacagagccagacactgtctctgaaagaaaaagaaaaagaaagaaaaacattgctgatgaaactgcggcctcttttgcagctctataaaaaggtatttagtcactggctaaggttgtactagataatcacatcactttaggtgatacatttagctgagcagggagatgtgtggtggcaaataccttttgttgcatatacatatacatttcccatgtagtagaaccttctctagaaaaaatcagaaaagaagccacttggctgcaagaaatcactaaagaagaaatggggtttgatgttttccctgatgttttcagttggctgaaacatcaaatcccagttccctggttcccttactgttccaggatacagattctctttgtgatgatcattcttgtatgcattatatttctactactcaaattattaatgttatgtatttctcattgttttacttcttttgagaaactaaattcatggtactctgaaaactagagatgattcaacaagtgacagcaactatagaattggccgagatatctctctctctctctctctctctttttttttttttttttccatgttgtgatgccacaccagttcagcttttggacgctgttaaaaagagaggtctccttccctcccctgacccccgtgtgggacaggactatctgggaatgagccattctggcaaggagggacacagcttttgatcgacaatgctttcaagaaatactttttttttttttaaacggagtctcgctctgtcgcccaggctggagtgcagtgggcgatctcagctcactgcaagctccgcctcccgggttcacgccattctcctgcctcagcctctgcgagtagctgagactacaggcgcccgccaccacgccaggctaattttttttttttatttttagtagagacggggtttcaccgtggtctcgatctcctgacctcgtgatcggcccgcctcagcctcccaaagtgctgggcttacaagcgtcagccaccgcgcccggccaagaaagacttttcatctaaagggagaatggggaaagaagagaacttttttattttcaaattctcaggcccagcgaggcattacattgagacagcaaccacattctgcttcctttttgtacactactgtatttgaaaaacaaaaaaacaaacctacaagactcataaaactggacaactttctttataacactactactcgtaaaaccagtaaggatggctggtttgcagttatctgagcagcttctctagtttcatagacatgatttctctctgttattaaagggctcccaattttaagtggaatgctacttcacaaagataaccaggtttgaaagggtccggtttgctttgtaatccgaaacgttccagtctgctattaaaagccattatttgaagacgggtgcacaggcttccagctgcccgccagaagggtcctccgcaggacacaggttaagtaatcacttcttcgggggagactagatgcagggtctcggcgcacctccccaaaagacaagggcgagacagaaaggagggacaggcggacgtcacttcccccgccggctgcggcaccgggttggtgggctgagtggaggagggtggggcggaagaacagaaggggactgggaaaggcactgttggtgacatcaccgatagggcgtttctatgtagatgaggcagcgcaggggctgctgcttcgccatgaaggatttcccgtgctgtaggagcaagtccgggaccgctggctggacgtgagcgtcctagctgtgcgttagggctaggagggctcagggtgattggggattggctggggtggtgctcggggcaagtgaccgtgcgtgtaaagggtgaggcgtatggagctgtggcggggcggaagttcacatgtgtggtatgtagagcacatgttatggttatcaaagtggtttactgtaaggctgagggctatgcattctatggctatgttgttgtctcttatttttccaaacgtggaaacctctgttttgtaacttgtagtaataaggtagaaattaaaaagaaaaagtattttcctgtacttgcttggctgcaaggtcaggaacagatagtttctgaaaaaccacatcgctgagaaatgagttctggagactctcttaacagtctgttatccctaggaaggataagagcaagaaacagcaaatgcttttattaccttctcttttccctttaccatttctcactattcaagttttgttaagttcttgatttcccttcagtgcagctgcaaggtcaccagctattcttgcctcgtgagacctgtcacagtttgactagctgcctttgttctgcttctgtaagccctcttgcctgccccgcgagtttggtgccatcatagtcccaccatgccattcaaactagccaaccccctttttgaagtgtgtataaaagtcaaaccctgtctttgttcggggctcagcctttggattttaatcctctgggcctgagggcactcaataaaatcctcctgttccacccattggtctctctgttctcctgattcccacaacagtagtaggggactgtgtctgcactttcccctggtctttcacggtatgaataatagccttttttttttcgcctatagtcgcaggctcggtctcagtgattttatggtgtggtcagctgtttttgtttttgtgagaccttgtttactgtcctgggacagatgtctgtagtcacttgtttccttgggaggcaaatttcagtctctgtggcagaggtctctcatgttagctgtggtggtacttggcaggcggagctcagggatctaggcttccctgctttgtagactgctcaatggtccccaaggcctactggcttttaccaccacttgaaaaccttagtgtttttccactgtccccagagtcacctcttacacagacttattttgtttgtctttttccccgagacagagtctcactctatctggtagcatcttggtttaagcgatcctcccacctcagcctctggagtagcagaggcacgagtcaccacagccagctaatttctgttcttggttttgttgtggtggtggttgttttgttttttaagagttgaagtttcaccatgttgcccaggttggtctccaactcctggactcaaataatccgccctgccttggccttctaaagtcctgggattacaggtgtgatccatcacacctggccagcccctgcttttcactatagcattcatgggagtttgcaggatttctgtgctggggggaacgtgtactcagctcatacagccaagtagaaattgtacttggaactggtgccgttgggttgtagacataacatgcttgctgtttgtatgggaagggctttgccagtgctctgtgcccctgtgcagggcatccaggcctgcaggtcagaacggcagtctcacctatgagtttgtgtaatacgcagcaattctccctggaatataagatgggtggtcttgtgaggttcctacaagtaagaagacaaatttcccttcagtttgtattgacaaaattcaaaattaataataacagcccaacctcttgaatgataaatgtcctttacattgacagaccagaactgccctgcttgcctcagctcctctgtgcaggtgcagctcacaattccccccacacaggtcatttcctccctgctttctccaaaagagggagacagcagttctgcaggaccacagggctcaaggccttccagggccaaaaatctcagaagaagttgcccgttctgcctgtacctcacgactgacctagaaatggcctttgctaggagcaaagtagggggaaatggtcgccagagctggggcctgggtactgggccaggttaccccacaggaggggaagtactcagggttagagggggccaagcaccaagacctcagcatcctcaacctccaaaaggactcagagagatgcagaaaccgagacagggttcctctttcaaggaaagagacttttgaggaagaccccagggctctgaaccaaaatccagatttttccccatctgcagcttaattccaccttagttggtgcaacttcatccttcccctatgctcaggacaaaaaacagttcttctataggctggtcattctctggccccatacatcctattggtcagaaaattatgttttttctttggttaactgcagactttggtctgcacagtctttttctttcttggtctgaaaaccacccagtagtcccatatgtagcttttttggataaacctagaaattgaccctgctggtcttaaagcttgaaacttaatatttgtttcgtctgagttccttcctcaggaaacaaccttcaggcctctcaaaaaagccatcaaagaactgaaattcatccagacaatgagatgctgggacccctcattcatcatgattgcttccttgctcctccctagttcctgttttcttacacattgttacatttcttccctgccatataaacctctggttttgttggtcagggagatggatttgagactgagttctcatctcccccactgcagcaccctattaaagcgccttccttggcaataatcatctcggtgattggctttctctgtggcaaccagcaggaatcccagatctctgaattttggcaaaggagtctcctgataaaggtgggatggattctactgaccaacatcaaaacgatcagacatttgaaagccttaatctcagggtcggggtttgggccgcccttgggccttttccttgggcctaaccattaaaatcagcctagccaggtctgtcttccaggcacaggggtagggccagatactcctgatgctttttgacgcttctcccactgggtgggcaacaaccctccccttccctgtgacctgcagagaagcttcagggggcgtttattcaatttgctaggagcctacaaagcacaggtacacggtgactctgtggttcccactgcacctgccactctccttggtcccctcactgtctctggcaggcagtaatgttctgggtgagcttgggtgctgaagacacccaggcagggagggtagggaaaggcaccagccccttaggtcctgcgcattagggatccaaaaaacatctgaagaaacagaaagggagcgttggaagtagatcaaagggaaagaaagaaatcctaggagatttcctatctgaaggcaccatgaagagaaagtccgcctcctctgggccgcgtcctcctgttgcaggtgaaccgagttccggtctccattggaaaccaaagcaggtaactttgccctgactcctagttaggaagccatgctttgtcctcccctgtttagcacttgatcctgtagcacttgattgtctctccctggctttctatggattccagagatgcaactgagaagtttgtttttaatgcacttttccttaaagtaagagtatttcaggccgggcacggtggcttacacctgtaatcccaacactttgggaggcagaggtgggcattttacttgaggtcaggagttcgagaccagcctggccaacatggcgaaactctgtctctacgaaaaatacaaaaattagccaggtatgttggcaccggcctgtagtcccagctactcgagaggctgaggcaagagaaacctgtgaacatgggaaggggaagttgcagtgaactgatatcaaaaaaaaaaaaagtatcttttggcaaaggaaatgatttctgacaggttttgcacttaagacactcaggtgtgaggaaaacatgaaaaccactatgctagggaaagcaaatgctgttgagaatgtctcataaacacaaattacatgtcagcaggtaggtttgaccctcaggttgggcacattttactttaagttcactgtcggtggaacttaagatgaatctaagacattcacgatgtatgtatgtatgtgtgtgggtgtgtatacatatacatatatgtatacatatatatacacacacacatatatatatatacacacatatatatatgtctctcatatatatatgagagacagagtcttgcaatcttgcccatattggtctccaactctgggcctcaagcgatcctcctatctccccatcccaaagtgctgggactataggcatgcaccacctcgtccagcccattttaatgtttttaatttaaatacacattcccaaaattatataacaagtacaggaagcccactttcagccagttttacaaaaacaaagtggcaacatcctaaagtactgaaagaaataaagttttcctagaattctatgtcaaagtgaaaaatctttcaagaatatgactgaaataaggacatttaaaaacatataaaaaatgaaagaattcagcaacccacactacaagaaatgcaaaaggagtcctccaggcctaaagataaggataccagacagaaatctggatctacacaaagaaatggagactactgcaaatcggtatgtacatagttaaatatatatgttcttattatttaaatcttttttaataatttatttattttaaattatttatgatttaagtctttttttaataattaaaaaaagcaataataatggattctgggatttataacatgtctgaaatcaagttacatgacaacactagcataatggccagaagaggaggtataatgccactagatggcactgataaaggtgtattcaggaaaccctgaagccctcactgaaaaggcaaaagcagggaaagaagtcggggagcggtagaccagaagaaagaaagagttatagctaataagccaacaaaggaaagaaaatggaatgatataaaaaccatgtaatcattatgctggaacaactgctcttcatgcactccagcctgggcgacagtgaaaccctgtctcaaaaaaaaagcccacccctagggctgggcatggtggctcacgcctgtagtcctaccacttggggaggccaaggcaggttgatcacctgaggtcaggagttcaagaccagcctggccaacatggtgaaaccccgtctctactaaaaatacaaaacaattagccaggcatggtggtgggtgcctgtaatcccaggtactcaggaggctgacgtaggagaattgctagaaccctaggaggggaggttgcagtgagccgaggtcatgccactgcactccagcctgggcaacagagcgagactcatctcaaaaaaaaaaatcgtacacttaaaaggtcacggaggcaagcaaaaatcacctggtggctgcaaagcagaccatcgagaggcaaaactctttatctggggaatttagaggcaattagacttccttattatttaaagcaagaatctagttccaggcttctttcccaaaaatttataactaactagaatttctggggttttttttttgttgttgtttgtttgtttgtttgagacggagtctcactctgttgcccaggctggagtgcagtggcgcaatctcggctcactgctacctccgtctcccgggttcaagcaattctctgcctcagcctcccgagtagctggaattacaggtgcccgccaccacacccggctaatttttgtatttttagtagaaacggcgtttcaccatcttggccaggctggtcctgaactcctgacctcgtgatccacccgactcgccctcccaaagtgctgggattacaggcgtgagccaccgtgcccggccagtaactagaatttctatacatctctggaatacgtgcttatcaaaacttgtgcaacccttgctgacattaaggcaccaaaatgtctacaaatgtagtattctgtgagccaccgcacccggcctacaaaatgtttttttaaaaaattattgtgttgggagtgaattattgggctggtggctcatgcctgtaatcccagcacttcaggaggccgagatgggtggatcacttgaagtcaggagttccagaccagcctggccaacatggtgaaaccccatctctactaaaaatacaaaaattagctaggcgtggtggcgggcacctgtaatcccagctacttgggaggctgaggcaagagaattgcttgaacccaggaggcagaggttgcagtgagccgagatcgtgccattgtactccagcctgggtgacaagagccaaaaaaaaaaaaaaaaaagaaagaaatcattattatttctacaatatgggcttatccctgtattactcttctgaacttttcacttaatatatcgtaaccatctctccagtcattgaatgttcttctataacatttggaatgatatcatagtatcccattatatgaataacccatggtttattatacaagtcccctactgctgaacgtttaggtctttctaactttttgctattaaagtctggcatgatagactctgcaagttagccttcagatgcccagcaaatccagttaaccagagcactgtcctctaagcctcctggtgaatgtggttttgctgatggtgggcagagtccaccccagccgagccgctggatttggcaggcacttggccttagcaacctgagggtggtaactccaatcagttacttgtttccctgttacctgagttgcagatttagagccctctgcagtgagcaggtgagcacctggcatgattcttttctggtgagtggtcctgggggtcactgggccagtcaccacctggtgacaggacagggtgaccggtgggtggcagcactggggattcaaatgaccgcagcccggtcaggctgagctgagcagagccaaggactcagcacagcaaggaacctaggctcttcacagagaagggagctggaggaccccccaaggagatgagtatgtgccaccctgcggcagggtcctgtgggctttgggagtgagagggtcaaggggagaggagctgtgtttgccaccccctgttaaaaacctcaagtgaagcagcatggtagagaggaaagagcatgggattggaagccattgaacttcctgctgtgtgtccttgggcaagtgactacatgtctctgatcctcaatctccccttctataaaatggagatgatcctagaacctgcttcacgggagtgttcagaggggactgtagacagagcgggaacatagaagaggaagtaggcggcagtgtggttcacagccagcgcaggctgcctgcagggtgcaggtactgtcaccaagggagacccaaggtgccctggagggagtggcaaggacacaggcctgagcccagccctggtgatatgaacactggagtgggcttcacagggacaggcagcatcagaactggactagtgaggtcatgagcccaccagggcctgggtagggacatagcaagtctggggactccagacagggtcacacagacctgggccatgctgggcatccagggactggctgtgcatactggcagatgtcagtcagccctcctgcagttgggccagggacacctcagggaaactgtgaccttccttccaatcttggtaacatcacccttccaccccaaatcccagggaatggcccgaatctctcctgacaaacagctctcagccctggtccaggccacagtcttgcttgcaccgggccgggtttcagagcccgaagggcacactggcagcctttagtgcagtgtttcagatgtcacagacaggttcctctttgacgaagatggaacttccactgcttccctcctaccacgcaggaaacacagaagcaaccatcagccgagggcctgctggccgttctctctgggtactgtgtttggaaaaagcacaaaatcattaacttaaacatgctttttcaaaccaaacacatccctctcttagccctggagattcagagctgcctctccctttgaaaatgaatgatctcgcccgggtgcagtggctcacgcctgtactcccagtactttgggaagctgaggcgggtggatcgcgaggtcagcagtttgagaccagcctggccaatatggtgaaaccccgtctctactgaaaatacaaaaattagccgagcgtggcggcgggcgcctgtagtccaagctactcaggaggctggggcagaggttgcgtttagccaagatcatgccactgcactccagcctgggcaatagagcaagactccctcaaaaaaaaaaaaaagcatgatttcatccaatgccttcaataacagaaggaggtccaagtccagtgagagggtggaacgaacatactgtcacagtggaaaggacacgagacaggcgcgccaccgggttgagtctcgcgaacaaactgaggccagagtgccttccccagggctgcacgtcagtcaggaaaaaaaaaagcattctctccgacaggtcaaatcaccgaagcctcgggatcgtcgctgggggctgtgacggggctggcatgaaacgtccctctgtctggctgggcgatgggtcagtgctcaggagtttcaggcctttaaggcccggccagaccgcagggggactctgcagccgggtcggggtttcgatcctgcgctgcggccttgcaactgcgaggacttgggggtcgtgcttcgttcgcctggtatcctcgttcgtgcgtgtaggaggcgcctggcttgccgggcggtgccaggcggcaagagggagggcgcacggagcgtgtccgcccagggcggcccctgtaagcgctgcagaagcgctgctcccggcgcccggccccgccccagcctccgccccactaccgcgcagcgcaggctccgcccccagttttccccgccccgtggcggggacgccccgcccggtccggcccgctcggcctcggcagcagcggctgcggcgaaggcgcgcgaaggtaggtggccgggggcgcgcgcgtgcgcgggggcgggacggacgcgctcccggcggaggaggccgcgcgcctgggggcgggctggagccacgtaccggggctgggggcgctgtgtgttccgcgactgccgcggcccggcaccggaggccaggagagcgttcccaacaggctccgcggatgccccgccgcgtcctgccgcccatcctgcccggattgtcgcgggccgggggcacgacaggagactggggcctgcagggcgcagccgtccctccgccggccggggtcccctcgctccgcgggcggccgtgggaggccctcgcgacggcctctgccccccgcagatgccctctgcagctcctgcgtgcgggccccgccctgcactgccctcctcgtgtgggatccggtttcgtcttcattgcagccctgccgagtcggaagcatctccattgtgcggatggggaaactgaggcccagagcgcatagttgggctggccacggaggcagggccgccggatgctgtgcggggatggggccctgcaccccttgcgcctctcaccatgcggcctcaggcctctgtgcccggcagcgtctctggagtgggcattttgaacgagctccctcctgattttcacacagacttaagcctgacgaccatgctggggcggatgtctgcccctctggtgaccaggtcacagctcccttgggaagacgattgactggggaatggggaccctggggaggaggacttcagggtgccatctgtctgtttacgccagaaaacagagatttctgttttctttcgctgggctcacagcaggtgcttaataaacagatcttgtggcgggagcagacgacagcgaggttcaggcaagactccaggagtcaacccctggatctcggaggctccccacccgcgcacatttccctgacttaaccctcccctccccaagtctttcagccctttccacccaagtggcccctgtgggggtcactgcctggttttcaccctgatcttctgggatgcggcagatgctggctggatatgtgttcgctggtgtccttccgtgatccccgtctgtggctgacaccatctgtggcccaacatgaccccagccagagccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccattccctgtagtcatttccattaatataaatagttaacgtttgacgggtatgttcatgtcagtcattaaaggagatgctttatgtgtagctgtgcagctgtgggaagttgctgctgatctctgagcctccatttcatcatctgttaaatggggatgaggataaactacataggcatgttatgaagacaaaatgaggttatgtctaaaatacttagctgggcgcttgacccatagtaagtgctcagtcaggaatagggttgttttttgtttgtttgttttgagacagagtttcactcttgttgcccaggcgggagtgcaatggcactatctcggctcacctcaacctctgccttctgggttcaagcgattctcctgcctcagcctcccaagtagctgggattacaggcatgcatcaccatgcctggctaattttatatttttagtagagacggggtttcgccatgttggtcaagctggtctcgaactcttgacctcaggtgatccacccgctttggcctcccaaactgctgggattacaggcatgagccatcacgcccagcctgtttgttttttgagacagagtctcactcttgttgcccaggctggagtgcaatggtgcgatctcggctcactgcaacttctgcctcctgcattcaagcgattctcctgcctcagcctcccaagtagctgggactacatatgcccgccaccatgcctggctaatttttgtatttttggtatagacagggtttcgctgtgttggccaggctggtctcaaactcctgacctaaggtgacctacctgacccagcctcccagagtgctggattacaggcatgagccactgcgcccggcctatttgtttttttgaggcagagtctcactcttgttgcccaggctggagtgcagtggtgcaatctcagctcactgcaacttctgcctcttgggttcaagcgattctcctgcctcagcctccctgaggctgggactacatacgcctgccaccacgcctggctaattgttgtatttttagtagagacagggtttcaccatgttggccaggttggtcttgaactcctgacctaaggtgatccacctgccccagcttcccaaagtgctgggattacaggcgtgagccaaggcacctgacctagggttgttatatgtttgacatccgtcccatttgggaggccttctcatcagtcattttatgcctttaatgccattctaggtaggcaggaaaggggtcagggccagtgggcccatgtagcatatagggaaactgaggcccagagagggcaagccacttcaagaggacccaaactagatgccaggcaggccctctgcctctgggattttgcccatgtggctcacctggcctaagtctgctggcccaaggaaaagtttcaacccaaccctgccctttcccccattcctctcgtgcaggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctgatgcagagggtccacaaccacatttgggaaatactgacctaatgtacagcaggaaagcactttcatttgctaagaagtactgtttgcatatgaagagccactcagacctcagcatatagaaaggcaaggggccagggaagttactagaacactgactctgggtttgaattgcctgggtttgaatcgaatcttggtcgcttactggtgatgctacccaaggtgtccgtgccttcatttccccacctgtagaaatagggataggatagtgaaaggtattgaagatgagctgagaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttcttttttctttttttgagacggagtcttgctctgttgcttaggctggattgcagtggcgcaatctcggctcactgcaacctccactttctgggttcaagcgattctcctgcctctgcttcctgagtagctgggattataggcgcgccaccacgcctggctaatttttgcatttttagtagagacgggatttcaccatattggtcagggtgtctcgaacttttgacctcgtaatctgcccacctcggcctcccaaagtgctgggattacaggcatgagctacggtgaagatcttaaagaaggggcggtttggccggtcgtgctgactcatgcctgtaatccagcactttgggaggccgaggtgggcagatcaccaggtcggaagatcgagaccatcctggctaacacagtgaaaccccatctctactaaaaatcacaaaaaattagctgggcgtggtggcacgcgcctgtagtcccagatacttgggagggtaaggcagaagaatcgcttcaacctgggaggcagaggttgcagtgagccaaaatctcgccactgcactccagcctgggtgacagagcaagactccgtctaaaaaaaaaaaaaaagaagtggcagctctgtctgcttctcacagagttgctaggggcaagtgctgaggcaggcacctgccctcaggctccccaggtgggctgctatttgcctgtgggctctgcctgcccgcctgtccagtccccagggatctgaactcctgtgacctcccccttgctcttcttgccctttgcattgcctggcttggcctcattaatgtccccaaatctgtgttctctccagctcctctggcaacccctgacccccttcattcctcacagccagtcctaactcccctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggccccacccctgcctggggctctggccctgtgactcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggttcgtgagccctggcatggcctctgctgctctctgagctgctccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacggagacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgggtagggcaggctgggcagctgggcctctgtctcatagagaggcacatccctggctgaggagcccccaccacggggcggcatggccctgtcctggagaagcttccaggctgtgggaaaggaggtttagcccttcttttgggagcccccatctgagggaggtggctcagccctgccctgatgaatccttttggcgtgagggagaggctggctacacgggcagcactcactatgcatccaggggttggcagagggtccggcaggccagcgggaggggccgtgtttagagctaaaagtggacagtgcactgagcgggttgggagcagcccggggctgggggacacagcaggaccaagtctgaggagcccctctgtcccagagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggtgagcagccgcccccctcttccaagcagcataccctaaatggcactgtgtgcctgggggcctagttccccagggccccagaagagtgtaagattcctccctgcatttgaggaccaatgaatagcaacttagaaaggaggcagcaagcactacgaagcacctgttgtgtacaggtgggatttggcctcaaggaggggtgagtggggtctctgccctcttggtgttgtgctcaggacagtcctgattgatggtgacttcaggtcaaaacattactgattacagcacgccttgctcaaatgataactcacagcctgcggtctgagcactgcagagggatggggcaggctccctgggtccagggatctggggtacaagacccagcttgacgggggggtccctgaccgctgccctggggacacctgctgtgctcacaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcaggtggggtgtcgcaggaggaccagtcctgagtcctcatgggatcccatccctgaaacctaacttcacccccaacgttctggggaaattgcccagatacggatcctctgtctcctaagcagagcctggcacctgggtgattttaggaaggtttcctccctgttgattggggaaaggggcagaggggcagtgggcagctttgggtccagactcagacccacccaccgtcatcaccctggaaaccaggtcccctcctggagtcactggtctacccctcccagccgagggcctgggccccagccctgcagggctcagggcttagctcttcagagaggccacatgggcaggcagtgcctgatccactccagaaattggaggagacggcttttgtgtagagccactgactactcccaggacccagggcagcccctgacctctgccctctccagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcaggtactctccctgtgccaccccttagcctggggcttgctgtgtgccccgggccaatagctccccctttctggaattacgtttctacccctatgtaaaaccaggggcttgaactatgacaagccctctcacctaaccttggtgtgaatggatgggctttgaggagtccttgaatccctgaaactgtgcaaaagtctgcgtgcatttgtgtgcacactcaggctcacatttctgcaaggagaggagctggtgtccttgtccagttctcaaaggaatctgcaaacaacaaaaggtacagattttgtgaactaggtcagaggttggcaaatggttttttgtaaagagcccaaatggtcaatatttccagctttacgggccacacagtctctgttgcaactacttgactctgctggggtagtgagaaagcagtcccaaacagtgcatgaacagaggggtgtgggttccagtaaaactttgtttagggacactgaaatgtgaattttctgtcattttcatgtgtcaagaaatgttgttcttcctttagaaatgatccattttcgatgatttaaaaatgtaaaaaaaaaaaaaaatccttaactcagacccttgtagaaacgggagatgggctgaatttggcctgtgagctgtagttcgctgacccgtgaattcgatgatctgcaaactcaacagcagcatgtattgaagaagcacctgctgtctactgggcactggcctggacactgtgggttcaggc
